United States Patent 12,508,308 (INFLUENZA mRNA VACCINES) - sequence listing, part 30

SEQ ID NO: 113712 - RNA, 1410 nt, Artificial Sequence
  derived and/or modified sequence opt2 from neuraminidase__InfluenzaA__AFJ11709
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcucaucuga

SEQ ID NO: 113713 - RNA, 1410 nt, Artificial Sequence
  derived and/or modified sequence opt2 from neuraminidase__InfluenzaA__AFJ11720
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucaucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113714 - RNA, 1410 nt, Artificial Sequence; identical to SEQ ID NO: 112655
  derived and/or modified sequence opt2 from neuraminidase__InfluenzaA__AFJ11731

SEQ ID NO: 113715 - RNA, 1410 nt, Artificial Sequence
  derived and/or modified sequence opt2 from neuraminidase__InfluenzaA__AFJ19845
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccgacguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113716 - RNA, 1410 nt, Artificial Sequence; identical to SEQ ID NO: 108250
  derived and/or modified sequence opt2 from neuraminidase__InfluenzaA__AFJ44697

SEQ ID NO: 113717 - RNA, 1410 nt, Artificial Sequence; identical to SEQ ID NO: 111769
  derived and/or modified sequence opt2 from neuraminidase__InfluenzaA__AFJ69989

SEQ ID NO: 113718 - RNA, 1410 nt, Artificial Sequence
  derived and/or modified sequence opt2 from neuraminidase__InfluenzaA__AFJ69990
augaaccccaaccagaagaucaucaccaucggcuccgucugcaugaccaucggcauggccaaccucauccuccagaucggcaacaucaccuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113719 - RNA, 1410 nt, Artificial Sequence
  derived and/or modified sequence opt2 from neuraminidase__InfluenzaA__AFJ69991
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaaccaggaccucucccacuccgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113720 - RNA, 1410 nt, Artificial Sequence; identical to SEQ ID NO: 109076
  derived and/or modified sequence opt2 from neuraminidase__InfluenzaA__AFJ69992

SEQ ID NO: 113721 - RNA, 1410 nt, Artificial Sequence
  derived and/or modified sequence opt2 from neuraminidase__InfluenzaA__AFJ69993
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucggccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaaccucaaccucaugcccaucuga

SEQ ID NO: 113722 - RNA, 1410 nt, Artificial Sequence; identical to SEQ ID NO: 111030
  derived and/or modified sequence opt2 from neuraminidase__InfluenzaA__AFJ69994

SEQ ID NO: 113723 - RNA, 1413 nt, Artificial Sequence
  derived and/or modified sequence opt2 from neuraminidase__InfluenzaA__AFJ74389
augaaccccaaccagaagaucaucaccaucggcuccaucuccaucgccaucggcaucaucucccucauccuccagaucggcaacaucaucuccaucugggccucccacuccauccagaccggcucccagaaccacaccggcgucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113724 - RNA, 1410 nt, Artificial Sequence
  derived and/or modified sequence opt2 from neuraminidase__InfluenzaA__AFJ74399
augaaccccaaccagaagaucaucaccaucggcuccgucucccucaccaucgccaccaucugcuuccucaugcagaucgccauccucgucaucacccucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuucuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113725 - RNA, 1410 nt, Artificial Sequence
  derived and/or modified sequence opt2 from neuraminidase__InfluenzaA__AFJ74410
augaaccccaaccagaagaucaucaccaucggcuccgucucccucaccaucgccaccaucugcuuccucaugcagaucgccauccucgucaugaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucaucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113726 - RNA, 1410 nt, Artificial Sequence; identical to SEQ ID NO: 105827
  derived and/or modified sequence opt2 from neuraminidase__InfluenzaA__AFJ74451

SEQ ID NO: 113727 - RNA, 1413 nt, Artificial Sequence
  derived and/or modified sequence opt2 from neuraminidase__InfluenzaA__AFJ74462
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 113728 - RNA, 1410 nt, Artificial Sequence
  derived and/or modified sequence opt2 from neuraminidase__InfluenzaA__AFJ74517
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuacaugaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaacgaggucugguggaccuccaacuccaucgucgucuucugcggcaccuccggcaccuacggcaccggcuccuggcccgacggcgccgacaucaaccucaugcccaucuga

SEQ ID NO: 113729 - RNA, 1410 nt, Artificial Sequence
  derived and/or modified sequence opt2 from neuraminidase__InfluenzaA__AFJ74564
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaccgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagacccuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113730 - RNA, 1413 nt, Artificial Sequence
  derived and/or modified sequence opt2 from neuraminidase__InfluenzaA__AFJ74639
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacaacaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccuccuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113731 - RNA, 1410 nt, Artificial Sequence
  derived and/or modified sequence opt2 from neuraminidase__InfluenzaA__AFJ74640
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccggcuaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113732 - RNA, 1413 nt, Artificial Sequence; identical to SEQ ID NO: 113730
  derived and/or modified sequence opt2 from neuraminidase__InfluenzaA__AFJ74659

SEQ ID NO: 113733 - RNA, 1413 nt, Artificial Sequence
  derived and/or modified sequence opt2 from neuraminidase__InfluenzaA__AFJ74679
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacaacaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccuccuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113734 - RNA, 1410 nt, Artificial Sequence
  derived and/or modified sequence opt2 from neuraminidase__InfluenzaA__AFJ74680
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucauccucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113735 - RNA, 1410 nt, Artificial Sequence
  derived and/or modified sequence opt2 from neuraminidase__InfluenzaA__AFJ74701
augaaccccaaccagaagaucaucaccaucggcuccgucucccucaccaucgccaccaucugcuuccucaugcagaucgccauccucgucaccaccgucacccuccacuucaaccaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaucugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcauggccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccaggucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113736 - RNA, 1410 nt, Artificial Sequence
  derived and/or modified sequence opt2 from neuraminidase__InfluenzaA__AFJ74731
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgagaucaaccucaugcccaucuga

SEQ ID NO: 113737 - RNA, 1413 nt, Artificial Sequence; identical to SEQ ID NO: 113730
  derived and/or modified sequence opt2 from neuraminidase__InfluenzaA__AFJ74766

SEQ ID NO: 113738 - RNA, 1410 nt, Artificial Sequence
  derived and/or modified sequence opt2 from neuraminidase__InfluenzaA__AFJ74767
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 113739 - RNA, 1410 nt, Artificial Sequence; identical to SEQ ID NO: 113738
  derived and/or modified sequence opt2 from neuraminidase__InfluenzaA__AFJ74783

SEQ ID NO: 113740 - RNA, 1410 nt, Artificial Sequence; identical to SEQ ID NO: 105657
  derived and/or modified sequence opt2 from neuraminidase__InfluenzaA__AFJ74807

SEQ ID NO: 113741 - RNA, 1410 nt, Artificial Sequence; identical to SEQ ID NO: 105657
  derived and/or modified sequence opt2 from neuraminidase__InfluenzaA__AFJ74822

SEQ ID NO: 113742 - RNA, 1410 nt, Artificial Sequence; identical to SEQ ID NO: 106226
  derived and/or modified sequence opt2 from neuraminidase__InfluenzaA__AFJ74834

SEQ ID NO: 113743 - RNA, 1410 nt, Artificial Sequence; identical to SEQ ID NO: 105657
  derived and/or modified sequence opt2 from neuraminidase__InfluenzaA__AFJ74845

SEQ ID NO: 113744 - RNA, 1413 nt, Artificial Sequence
  derived and/or modified sequence opt2 from neuraminidase__InfluenzaA__AFJ75039
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccuccgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcggcgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccaucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113745 - RNA, 1410 nt, Artificial Sequence
  derived and/or modified sequence opt2 from neuraminidase__InfluenzaA__AFJ75050
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccguccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgucgagggcaagaucguccacaccuccgcccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113746 - RNA, 1410 nt, Artificial Sequence
  derived and/or modified sequence opt2 from neuraminidase__InfluenzaA__AFJ75094
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccuccaacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaucgagguccucuggaccuccaacuccaucgucgucuucugcggcaccuccggcaccuacggcaccggcuccuggcccgacggcgccgacaucaacaucaugcccaucuga

SEQ ID NO: 113747 - RNA, 1413 nt, Artificial Sequence
  derived and/or modified sequence opt2 from neuraminidase__InfluenzaA__AFJ75104
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgccggcaacuccucccucugcuccaucuccggcugggccauccacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaucgccaacugguccuggcccgacggcgccgagcuccccuucaccaucgacaaguga

SEQ ID NO: 113748 - RNA, 1410 nt, Artificial Sequence; identical to SEQ ID NO: 107396
  derived and/or modified sequence opt2 from neuraminidase__InfluenzaA__AFJ75114

SEQ ID NO: 113749 - RNA, 1410 nt, Artificial Sequence; identical to SEQ ID NO: 107396
  derived and/or modified sequence opt2 from neuraminidase__InfluenzaA__AFJ75452

SEQ ID NO: 113750 - RNA, 1410 nt, Artificial Sequence; identical to SEQ ID NO: 107396
  derived and/or modified sequence opt2 from neuraminidase__InfluenzaA__AFJ75463

SEQ ID NO: 113751 - RNA, 1413 nt, Artificial Sequence; identical to SEQ ID NO: 113747
  derived and/or modified sequence opt2 from neuraminidase__InfluenzaA__AFJ75552

SEQ ID NO: 113752 - RNA, 1413 nt, Artificial Sequence
  derived and/or modified sequence opt2 from neuraminidase__InfluenzaA__AFJ75574
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgccggcaacuccucccucugcuccaucuccggcugggccauccacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagggccagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaucgccaacugguccuggcccgacggcgccgagcuccccuucaccaucgacaaguga

SEQ ID NO: 113753 - RNA, 1410 nt, Artificial Sequence; identical to SEQ ID NO: 107396
  derived and/or modified sequence opt2 from neuraminidase__InfluenzaA__AFJ75585

SEQ ID NO: 113754 - RNA, 1410 nt, Artificial Sequence
  derived and/or modified sequence opt2 from neuraminidase__InfluenzaA__AFJ75596
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113755 - RNA, 1410 nt, Artificial Sequence
  derived and/or modified sequence opt2 from neuraminidase__InfluenzaA__AFJ75607
augaaccccacccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgagaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccggcuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113756 - RNA, 1410 nt, Artificial Sequence
  derived and/or modified sequence opt2 from neuraminidase__InfluenzaA__AFJ75633
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113757 - RNA, 1413 nt, Artificial Sequence; identical to SEQ ID NO: 108973
  derived and/or modified sequence opt2 from neuraminidase__InfluenzaA__AFJ75654

SEQ ID NO: 113758 - RNA, 1410 nt, Artificial Sequence; identical to SEQ ID NO: 107396
  derived and/or modified sequence opt2 from neuraminidase__InfluenzaA__AFJ75665

SEQ ID NO: 113759 - RNA, 1413 nt, Artificial Sequence
  derived and/or modified sequence opt2 from neuraminidase__InfluenzaA__AFJ75676
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgccggcaacuccucccucugcuccaucuccggcugggccauccacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaucgccaacugguccuggcccgacggcgccgagcuccccuucaccaucgacaaguga

SEQ ID NO: 113760 - RNA, 1413 nt, Artificial Sequence; identical to SEQ ID NO: 108973
  derived and/or modified sequence opt2 from neuraminidase__InfluenzaA__AFJ75687

SEQ ID NO: 113761 - RNA, 1410 nt, Artificial Sequence; identical to SEQ ID NO: 108250
  derived and/or modified sequence opt2 from neuraminidase__InfluenzaA__AFJ76122

SEQ ID NO: 113762 - RNA, 1410 nt, Artificial Sequence; identical to SEQ ID NO: 112828
  derived and/or modified sequence opt2 from neuraminidase__InfluenzaA__AFJ76134

SEQ ID NO: 113763 - RNA, 1410 nt, Artificial Sequence; identical to SEQ ID NO: 108250
  derived and/or modified sequence opt2 from neuraminidase__InfluenzaA__AFJ76146

SEQ ID NO: 113764 - RNA, 1410 nt, Artificial Sequence; identical to SEQ ID NO: 108250
  derived and/or modified sequence opt2 from neuraminidase__InfluenzaA__AFJ76159

SEQ ID NO: 113765 - RNA, 1410 nt, Artificial Sequence; identical to SEQ ID NO: 108250
  derived and/or modified sequence opt2 from neuraminidase__InfluenzaA__AFJ76173

SEQ ID NO: 113766 - RNA, 1410 nt, Artificial Sequence; identical to SEQ ID NO: 108250
  derived and/or modified sequence opt2 from neuraminidase__InfluenzaA__AFJ76191

SEQ ID NO: 113767 - RNA, 1413 nt, Artificial Sequence
  derived and/or modified sequence opt2 from neuraminidase__InfluenzaA__AFJ76192
augaaccccaaccagaagaucaucaccaucggcuccaucuccaucgccaucggcaucaucucccucaugguccagaucggcaacaucaucuccaucugggccucccacuccauccagaccggcauccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113768 - RNA, 1410 nt, Artificial Sequence; identical to SEQ ID NO: 108250
  derived and/or modified sequence opt2 from neuraminidase__InfluenzaA__AFJ76206

SEQ ID NO: 113769 - RNA, 1410 nt, Artificial Sequence
  derived and/or modified sequence opt2 from neuraminidase__InfluenzaA__AFJ76216
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucaagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113770 - RNA, 1410 nt, Artificial Sequence
  derived and/or modified sequence opt2 from neuraminidase__InfluenzaA__AFJ77411
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113771 - RNA, 1410 nt, Artificial Sequence
  derived and/or modified sequence opt2 from neuraminidase__InfluenzaA__AFJ77422
augaaccccaaccagaagaucaucaccaucggcuccgucucccucaccaucgccaccaucugcuuccucaugcagaucgccauccucgucaucaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuucgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113772 - RNA, 1410 nt, Artificial Sequence
  derived and/or modified sequence opt2 from neuraminidase__InfluenzaA__AFJ77433
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaccgacuccuccuccuccuccgacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113773 - RNA, 1410 nt, Artificial Sequence
  derived and/or modified sequence opt2 from neuraminidase__InfluenzaA__AFJ77443
augaaccccaaccagaagaucaucaccaucggcuccgucucccucaccaucgccaccaucugcuuccucaugcagaucgccauccucgucaucacccucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuucuccaucgucuccuccuacgucugcuccggccucgucggcgacaccccccgcaagaacgacuccuccuccuccucccacugccucaaccccaacaacgaggagggcggcaacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113774 - RNA, 1410 nt, Artificial Sequence
  derived and/or modified sequence opt2 from neuraminidase__InfluenzaA__AFJ77465
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaagaacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113775 - RNA, 1410 nt, Artificial Sequence
  derived and/or modified sequence opt2 from neuraminidase__InfluenzaA__AFJ77476
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccagaucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113776 - RNA, 1410 nt, Artificial Sequence; identical to SEQ ID NO: 105827
  derived and/or modified sequence opt2 from neuraminidase__InfluenzaA__AFJ77487

SEQ ID NO: 113777 - RNA, 1410 nt, Artificial Sequence
  derived and/or modified sequence opt2 from neuraminidase__InfluenzaA__AFJ77498
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucaucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgagcgcggcaacauguccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113778 - RNA, 1410 nt, Artificial Sequence; identical to SEQ ID NO: 105827
  derived and/or modified sequence opt2 from neuraminidase__InfluenzaA__AFJ77509

SEQ ID NO: 113779 - RNA, 1410 nt, Artificial Sequence
  derived and/or modified sequence opt2 from neuraminidase__InfluenzaA__AFJ77520
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaucgagguccucuggaccuccaacuccaucgucgucuucugcggcaccuccggcaccuacggcaccggcuccuggcccgacggcgccgacaucaaccucaugcccaucuga

SEQ ID NO: 113780 - RNA, 1410 nt, Artificial Sequence
  derived and/or modified sequence opt2 from neuraminidase__InfluenzaA__AFJ77531
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaaggucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113781 - RNA, 1410 nt, Artificial Sequence
  derived and/or modified sequence opt2 from neuraminidase__InfluenzaA__AFJ77542
augaaccccaaccagaagaucaucaccaucggcuccgucucccucaccaucuccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113782 - RNA, 1410 nt, Artificial Sequence; identical to SEQ ID NO: 105765
  derived and/or modified sequence opt2 from neuraminidase__InfluenzaA__AFJ77553

SEQ ID NO: 113783 - RNA, 1410 nt, Artificial Sequence
  derived and/or modified sequence opt2 from neuraminidase__InfluenzaA__AFJ77564
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaacgaggucugguggaccuccaacuccaucgucgucuucugcggcaccuccggcaccuacggcaccggcuccuggcccgacggcgccgacaucaaccucaugcccaucuga

SEQ ID NO: 113784 - RNA, 1329 nt, Artificial Sequence
  derived and/or modified sequence opt2 from neuraminidase__InfluenzaA__AFJ77575
augaaccccaaccagaagaucaucaccaucggcuccgucucccucaccaucgccaccaucugcuuccucaugcagaucgccauccucgucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113785 - RNA, 1410 nt, Artificial Sequence
  derived and/or modified sequence opt2 from neuraminidase__InfluenzaA__AFJ77597
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacacccgcccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113786 - RNA, 1410 nt, Artificial Sequence
  derived and/or modified sequence opt2 from neuraminidase__InfluenzaA__AFJ77608
augaaccccaaccagaagaucaucaccaucggcuccgucucccucaccaucgccaccaucugcuuccucaugcagaccgccauccucgucaccaccgucacccuccacuucaagcaguacgagugcaacuccccccccaacaaccaggucaugcucugcgagcccaccaucaucgagcgcaacaugaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgaccucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113787 - RNA, 1410 nt, Artificial Sequence; identical to SEQ ID NO: 113785
  derived and/or modified sequence opt2 from neuraminidase__InfluenzaA__AFJ77619

SEQ ID NO: 113788 - RNA, 1410 nt, Artificial Sequence; identical to SEQ ID NO: 113785
  derived and/or modified sequence opt2 from neuraminidase__InfluenzaA__AFJ77630

SEQ ID NO: 113789 - RNA, 1410 nt, Artificial Sequence; identical to SEQ ID NO: 113781
  derived and/or modified sequence opt2 from neuraminidase__InfluenzaA__AFJ77641

SEQ ID NO: 113790 - RNA, 1410 nt, Artificial Sequence; identical to SEQ ID NO: 113781
  derived and/or modified sequence opt2 from neuraminidase__InfluenzaA__AFJ77652

SEQ ID NO: 113791 - RNA, 1410 nt, Artificial Sequence; identical to SEQ ID NO: 105552
  derived and/or modified sequence opt2 from neuraminidase__InfluenzaA__AFJ77663

SEQ ID NO: 113792 - RNA, 1410 nt, Artificial Sequence; identical to SEQ ID NO: 105552
  derived and/or modified sequence opt2 from neuraminidase__InfluenzaA__AFJ77674

SEQ ID NO: 113793 - RNA, 1410 nt, Artificial Sequence; identical to SEQ ID NO: 105552
  derived and/or modified sequence opt2 from neuraminidase__InfluenzaA__AFJ77685

SEQ ID NO: 113794 - RNA, 1410 nt, Artificial Sequence
  derived and/or modified sequence opt2 from neuraminidase__InfluenzaA__AFJ77696
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccgagaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113795 - RNA, 1410 nt, Artificial Sequence; identical to SEQ ID NO: 105552
  derived and/or modified sequence opt2 from neuraminidase__InfluenzaA__AFJ77707

SEQ ID NO: 113796 - RNA, 1410 nt, Artificial Sequence; identical to SEQ ID NO: 105573
  derived and/or modified sequence opt2 from neuraminidase__InfluenzaA__AFJ77718

SEQ ID NO: 113797 - RNA, 1410 nt, Artificial Sequence; identical to SEQ ID NO: 105573
  derived and/or modified sequence opt2 from neuraminidase__InfluenzaA__AFJ77729

SEQ ID NO: 113798 - RNA, 1410 nt, Artificial Sequence
  derived and/or modified sequence opt2 from neuraminidase__InfluenzaA__AFJ77740
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaucgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113799 - RNA, 1410 nt, Artificial Sequence
  derived and/or modified sequence opt2 from neuraminidase__InfluenzaA__AFJ77751
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccgcgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucuucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113800 - RNA, 1410 nt, Artificial Sequence; identical to SEQ ID NO: 105657
  derived and/or modified sequence opt2 from neuraminidase__InfluenzaA__AFJ77762

SEQ ID NO: 113801 - RNA, 1410 nt, Artificial Sequence; identical to SEQ ID NO: 105657
  derived and/or modified sequence opt2 from neuraminidase__InfluenzaA__AFJ77773

SEQ ID NO: 113802 - RNA, 1410 nt, Artificial Sequence; identical to SEQ ID NO: 105657
  derived and/or modified sequence opt2 from neuraminidase__InfluenzaA__AFJ77784

SEQ ID NO: 113803 - RNA, 1410 nt, Artificial Sequence; identical to SEQ ID NO: 106226
  derived and/or modified sequence opt2 from neuraminidase__InfluenzaA__AFJ77795

SEQ ID NO: 113804 - RNA, 1410 nt, Artificial Sequence; identical to SEQ ID NO: 106226
  derived and/or modified sequence opt2 from neuraminidase__InfluenzaA__AFJ77806

SEQ ID NO: 113805 - RNA, 1410 nt, Artificial Sequence; identical to SEQ ID NO: 106226
  derived and/or modified sequence opt2 from neuraminidase__InfluenzaA__AFJ77817

SEQ ID NO: 113806 - RNA, 1410 nt, Artificial Sequence; identical to SEQ ID NO: 106226
  derived and/or modified sequence opt2 from neuraminidase__InfluenzaA__AFJ77828

SEQ ID NO: 113807 - RNA, 1410 nt, Artificial Sequence
  derived and/or modified sequence opt2 from neuraminidase__InfluenzaA__AFJ77839
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113808 - RNA, 1410 nt, Artificial Sequence
  derived and/or modified sequence opt2 from neuraminidase__InfluenzaA__AFJ77850
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccaaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113809 - RNA, 1410 nt, Artificial Sequence; identical to SEQ ID NO: 106226
  derived and/or modified sequence opt2 from neuraminidase__InfluenzaA__AFJ77861

SEQ ID NO: 113810 - RNA, 1410 nt, Artificial Sequence; identical to SEQ ID NO: 106226
  derived and/or modified sequence opt2 from neuraminidase__InfluenzaA__AFJ77872

SEQ ID NO: 113811 - RNA, 1410 nt, Artificial Sequence; identical to SEQ ID NO: 106692
  derived and/or modified sequence opt2 from neuraminidase__InfluenzaA__AFJ77883

SEQ ID NO: 113812 - RNA, 1410 nt, Artificial Sequence; identical to SEQ ID NO: 106226
  derived and/or modified sequence opt2 from neuraminidase__InfluenzaA__AFJ77894

SEQ ID NO: 113813 - RNA, 1410 nt, Artificial Sequence; identical to SEQ ID NO: 106226
  derived and/or modified sequence opt2 from neuraminidase__InfluenzaA__AFJ77905

SEQ ID NO: 113814 - RNA, 1410 nt, Artificial Sequence
  derived and/or modified sequence opt2 from neuraminidase__InfluenzaA__AFJ77916
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucaucgucuucugcggcaccuccggcaccuacggcaccggcuccuggcccgacggcgccgacaucaaccucaugcccaucuga

SEQ ID NO: 113815 - RNA, 1410 nt, Artificial Sequence; identical to SEQ ID NO: 106248
  derived and/or modified sequence opt2 from neuraminidase__InfluenzaA__AFJ77927

SEQ ID NO: 113816 - RNA, 1410 nt, Artificial Sequence; identical to SEQ ID NO: 106248
  derived and/or modified sequence opt2 from neuraminidase__InfluenzaA__AFJ77938

SEQ ID NO: 113817 - RNA, 1410 nt, Artificial Sequence; identical to SEQ ID NO: 106226
  derived and/or modified sequence opt2 from neuraminidase__InfluenzaA__AFJ77949

SEQ ID NO: 113818 - RNA, 1410 nt, Artificial Sequence; identical to SEQ ID NO: 106226
  derived and/or modified sequence opt2 from neuraminidase__InfluenzaA__AFJ77960

SEQ ID NO: 113819 - RNA, 1410 nt, Artificial Sequence
  derived and/or modified sequence opt2 from neuraminidase__InfluenzaA__AFJ77971
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggacgagaccgagguccucuggaccuccaacuccaucgucgucuucugcggcaccuccggcaccuacggcaccggcuccuggcccgacggcgccgacaucaaccucaugcccaucuga

SEQ ID NO: 113820 - RNA, 1410 nt, Artificial Sequence
  derived and/or modified sequence opt2 from neuraminidase__InfluenzaA__AFJ77982
augaaccccaaccagaagaucaucaccaucggcuucgucucccucaccaucuccaccaucugcuucuucaugcagaucgccauccucaucaccaccgucccccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggcaucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113821 - RNA, 1410 nt, Artificial Sequence; identical to SEQ ID NO: 106224
  derived and/or modified sequence opt2 from neuraminidase__InfluenzaA__AFJ77993

SEQ ID NO: 113822 - RNA, 1410 nt, Artificial Sequence
  derived and/or modified sequence opt2 from neuraminidase__InfluenzaA__AFJ78004
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113823 - RNA, 1410 nt, Artificial Sequence; identical to SEQ ID NO: 106224
  derived and/or modified sequence opt2 from neuraminidase__InfluenzaA__AFJ78015

SEQ ID NO: 113824 - RNA, 1410 nt, Artificial Sequence; identical to SEQ ID NO: 113081
  derived and/or modified sequence opt2 from neuraminidase__InfluenzaA__AFJ78026

SEQ ID NO: 113825 - RNA, 1410 nt, Artificial Sequence; identical to SEQ ID NO: 113081
  derived and/or modified sequence opt2 from neuraminidase__InfluenzaA__AFJ78037

SEQ ID NO: 113826 - RNA, 1410 nt, Artificial Sequence
  derived and/or modified sequence opt2 from neuraminidase__InfluenzaA__AFJ78048
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcaacgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113827 - RNA, 1410 nt, Artificial Sequence
  derived and/or modified sequence opt2 from neuraminidase__InfluenzaA__AFJ78059
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggacgagaccgagguccucuggaccuccaacuccaucgucgucuucugcggcaccuccggcaccuacggcaccggcuccuggcccgacggcgccgacaucaaccucaugcccaucuga

SEQ ID NO: 113828 - RNA, 1410 nt, Artificial Sequence
  derived and/or modified sequence opt2 from neuraminidase__InfluenzaA__AFJ78070
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113829 - RNA, 1410 nt, Artificial Sequence
  derived and/or modified sequence opt2 from neuraminidase__InfluenzaA__AFJ78081
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacaacuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaugaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113830 - RNA, 1410 nt, Artificial Sequence; identical to SEQ ID NO: 113746
  derived and/or modified sequence opt2 from neuraminidase__InfluenzaA__AFJ78092

SEQ ID NO: 113831 - RNA, 1410 nt, Artificial Sequence
  derived and/or modified sequence opt2 from neuraminidase__InfluenzaA__AFJ78103
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccuccucggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccuccuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113832 - RNA, 1410 nt, Artificial Sequence
  derived and/or modified sequence opt2 from neuraminidase__InfluenzaA__AFJ78114
augaaccccaaccagaagaucaucaccaucggcuccgucucccucaccaucuccaccaucugcuucuucaugcagaucgccauccucaucaccaccgucacccuccacuucaagcaguacgagcucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaucaaccgccaggucaucgucgaccgcuccaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113833 - RNA, 1410 nt, Artificial Sequence
  derived and/or modified sequence opt2 from neuraminidase__InfluenzaA__AFJ78125
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaugaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113834 - RNA, 1410 nt, Artificial Sequence
  derived and/or modified sequence opt2 from neuraminidase__InfluenzaA__AFJ78136
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113835 - RNA, 1410 nt, Artificial Sequence; identical to SEQ ID NO: 113834
  derived and/or modified sequence opt2 from neuraminidase__InfluenzaA__AFJ78147

SEQ ID NO: 113836 - RNA, 1410 nt, Artificial Sequence; identical to SEQ ID NO: 113834
  derived and/or modified sequence opt2 from neuraminidase__InfluenzaA__AFJ78158

SEQ ID NO: 113837 - RNA, 1410 nt, Artificial Sequence; identical to SEQ ID NO: 107396
  derived and/or modified sequence opt2 from neuraminidase__InfluenzaA__AFJ78169

SEQ ID NO: 113838 - RNA, 1410 nt, Artificial Sequence; identical to SEQ ID NO: 107914
  derived and/or modified sequence opt2 from neuraminidase__InfluenzaA__AFJ78180

SEQ ID NO: 113839 - RNA, 1410 nt, Artificial Sequence; identical to SEQ ID NO: 107396
  derived and/or modified sequence opt2 from neuraminidase__InfluenzaA__AFJ78191

SEQ ID NO: 113840 - RNA, 1410 nt, Artificial Sequence
  derived and/or modified sequence opt2 from neuraminidase__InfluenzaA__AFJ78202
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaucaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcggcgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucucccucaugcccaucuga

SEQ ID NO: 113841 - RNA, 1410 nt, Artificial Sequence
  derived and/or modified sequence opt2 from neuraminidase__InfluenzaA__AFJ78213
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcucaucuga

SEQ ID NO: 113842 - RNA, 1410 nt, Artificial Sequence; identical to SEQ ID NO: 107396
  derived and/or modified sequence opt2 from neuraminidase__InfluenzaA__AFJ78224

SEQ ID NO: 113843 - RNA, 1410 nt, Artificial Sequence; identical to SEQ ID NO: 107396
  derived and/or modified sequence opt2 from neuraminidase__InfluenzaA__AFJ78235

SEQ ID NO: 113844 - RNA, 1410 nt, Artificial Sequence
  derived and/or modified sequence opt2 from neuraminidase__InfluenzaA__AFJ78246
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggccaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113845 - RNA, 1410 nt, Artificial Sequence
  derived and/or modified sequence opt2 from neuraminidase__InfluenzaA__AFJ78268
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113846 - RNA, 1410 nt, Artificial Sequence
  derived and/or modified sequence opt2 from neuraminidase__InfluenzaA__AFJ78279
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaucaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcggcgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113847 - RNA, 1410 nt, Artificial Sequence
  derived and/or modified sequence opt2 from neuraminidase__InfluenzaA__AFJ78290
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccgcccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113848 - RNA, 1413 nt, Artificial Sequence
  derived and/or modified sequence opt2 from neuraminidase__InfluenzaA__AFJ78312
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccugggagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113849 - RNA, 1410 nt, Artificial Sequence; identical to SEQ ID NO: 113781
  derived and/or modified sequence opt2 from neuraminidase__InfluenzaA__AFJ78323

SEQ ID NO: 113850 - RNA, 1413 nt, Artificial Sequence
  derived and/or modified sequence opt2 from neuraminidase__InfluenzaA__AFJ78334
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113851 - RNA, 1413 nt, Artificial Sequence; identical to SEQ ID NO: 113850
  derived and/or modified sequence opt2 from neuraminidase__InfluenzaA__AFJ78345

SEQ ID NO: 113852 - RNA, 1413 nt, Artificial Sequence
  derived and/or modified sequence opt2 from neuraminidase__InfluenzaA__AFJ78356
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgucggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcaucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113853 - RNA, 1413 nt, Artificial Sequence
  derived and/or modified sequence opt2 from neuraminidase__InfluenzaA__AFJ78367
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 113854 - RNA, 1413 nt, Artificial Sequence
  derived and/or modified sequence opt2 from neuraminidase__InfluenzaA__AFJ78378
augaaccccaaccagaaggucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccacauggagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgcccccgcgacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucgccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113855 - RNA, 1413 nt, Artificial Sequence; identical to SEQ ID NO: 105898
  derived and/or modified sequence opt2 from neuraminidase__InfluenzaA__AFJ78389

SEQ ID NO: 113856 - RNA, 1413 nt, Artificial Sequence; identical to SEQ ID NO: 105898
  derived and/or modified sequence opt2 from neuraminidase__InfluenzaA__AFJ78400

SEQ ID NO: 113857 - RNA, 1413 nt, Artificial Sequence; identical to SEQ ID NO: 105898
  derived and/or modified sequence opt2 from neuraminidase__InfluenzaA__AFJ78411

SEQ ID NO: 113858 - RNA, 1413 nt, Artificial Sequence
  derived and/or modified sequence opt2 from neuraminidase__InfluenzaA__AFJ78422
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaccggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccuccuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgcccccaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113859 - RNA, 1413 nt, Artificial Sequence; identical to SEQ ID NO: 108005
  derived and/or modified sequence opt2 from neuraminidase__InfluenzaA__AFJ78433

SEQ ID NO: 113860 - RNA, 1413 nt, Artificial Sequence; identical to SEQ ID NO: 108005
  derived and/or modified sequence opt2 from neuraminidase__InfluenzaA__AFJ78444

SEQ ID NO: 113861 - RNA, 1413 nt, Artificial Sequence
  derived and/or modified sequence opt2 from neuraminidase__InfluenzaA__AFJ78466
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggccgcugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113862 - RNA, 1413 nt, Artificial Sequence
  derived and/or modified sequence opt2 from neuraminidase__InfluenzaA__AFJ78477
augaaccccaaccagaagaucaucaccaucggcuccaucuccaucgccaucggcaucaucggccucaugcuccagaucggcaacaucaucuccaucugggccucccacuccauccagaccggcucccagaaccacaccggcaucugcucccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 113863 - RNA, 1413 nt, Artificial Sequence
  derived and/or modified sequence opt2 from neuraminidase__InfluenzaA__AFJ78488
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccaugaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 113864 - RNA, 1413 nt, Artificial Sequence
  derived and/or modified sequence opt2 from neuraminidase__InfluenzaA__AFJ78510
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113865 - RNA, 1413 nt, Artificial Sequence
  derived and/or modified sequence opt2 from neuraminidase__InfluenzaA__AFJ78521
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 113866 - RNA, 1413 nt, Artificial Sequence; identical to SEQ ID NO: 113759
  derived and/or modified sequence opt2 from neuraminidase__InfluenzaA__AFJ78532

SEQ ID NO: 113867 - RNA, 1413 nt, Artificial Sequence; identical to SEQ ID NO: 113759
  derived and/or modified sequence opt2 from neuraminidase__InfluenzaA__AFJ78543

SEQ ID NO: 113868 - RNA, 1413 nt, Artificial Sequence; identical to SEQ ID NO: 113759
  derived and/or modified sequence opt2 from neuraminidase__InfluenzaA__AFJ78554

SEQ ID NO: 113869 - RNA, 1413 nt, Artificial Sequence; identical to SEQ ID NO: 113747
  derived and/or modified sequence opt2 from neuraminidase__InfluenzaA__AFJ78565

SEQ ID NO: 113870 - RNA, 1413 nt, Artificial Sequence
  derived and/or modified sequence opt2 from neuraminidase__InfluenzaA__AFJ78576
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgccggcaacuccucccucugcuccaucuccggcugggccauccacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcaccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaucgccaacugguccuggcccgacggcgccgagcuccccuucaccaucgacaaguga

SEQ ID NO: 113871 - RNA, 1413 nt, Artificial Sequence
  derived and/or modified sequence opt2 from neuraminidase__InfluenzaA__AFJ78598
augaaccccaaccagaagaucaucaccaucggcuccaucuccaucgccaucggcaucaucucccucaugcuccagaucggcaacaucaucuccaucugggccucccacuccauccagaccggcauccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113872 - RNA, 1413 nt, Artificial Sequence
  derived and/or modified sequence opt2 from neuraminidase__InfluenzaA__AFJ78609
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucauccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113873 - RNA, 1413 nt, Artificial Sequence; identical to SEQ ID NO: 108973
  derived and/or modified sequence opt2 from neuraminidase__InfluenzaA__AFJ78620

SEQ ID NO: 113874 - RNA, 1413 nt, Artificial Sequence; identical to SEQ ID NO: 113747
  derived and/or modified sequence opt2 from neuraminidase__InfluenzaA__AFJ78631

SEQ ID NO: 113875 - RNA, 1413 nt, Artificial Sequence; identical to SEQ ID NO: 108973
  derived and/or modified sequence opt2 from neuraminidase__InfluenzaA__AFJ78642

SEQ ID NO: 113876 - RNA, 1413 nt, Artificial Sequence; identical to SEQ ID NO: 108973
  derived and/or modified sequence opt2 from neuraminidase__InfluenzaA__AFJ78653

SEQ ID NO: 113877 - RNA, 1410 nt, Artificial Sequence; identical to SEQ ID NO: 108250
  derived and/or modified sequence opt2 from neuraminidase__InfluenzaA__AFJ78664

SEQ ID NO: 113878 - RNA, 1410 nt, Artificial Sequence; identical to SEQ ID NO: 108250
  derived and/or modified sequence opt2 from neuraminidase__InfluenzaA__AFJ78674

SEQ ID NO: 113879 - RNA, 1410 nt, Artificial Sequence; identical to SEQ ID NO: 108250
  derived and/or modified sequence opt2 from neuraminidase__InfluenzaA__AFJ78684

SEQ ID NO: 113880 - RNA, 1410 nt, Artificial Sequence; identical to SEQ ID NO: 108250
  derived and/or modified sequence opt2 from neuraminidase__InfluenzaA__AFJ78694

SEQ ID NO: 113881 - RNA, 1410 nt, Artificial Sequence; identical to SEQ ID NO: 108250
  derived and/or modified sequence opt2 from neuraminidase__InfluenzaA__AFJ78704

SEQ ID NO: 113882 - RNA, 1410 nt, Artificial Sequence; identical to SEQ ID NO: 108250
  derived and/or modified sequence opt2 from neuraminidase__InfluenzaA__AFJ78714

SEQ ID NO: 113883 - RNA, 1410 nt, Artificial Sequence
  derived and/or modified sequence opt2 from neuraminidase__InfluenzaA__AFJ78724
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113884 - RNA, 1410 nt, Artificial Sequence; identical to SEQ ID NO: 108250
  derived and/or modified sequence opt2 from neuraminidase__InfluenzaA__AFJ78734

SEQ ID NO: 113885 - RNA, 1410 nt, Artificial Sequence; identical to SEQ ID NO: 108250
  derived and/or modified sequence opt2 from neuraminidase__InfluenzaA__AFJ78744

SEQ ID NO: 113886 - RNA, 1410 nt, Artificial Sequence; identical to SEQ ID NO: 108250
  derived and/or modified sequence opt2 from neuraminidase__InfluenzaA__AFJ78754

SEQ ID NO: 113887 - RNA, 1410 nt, Artificial Sequence; identical to SEQ ID NO: 108250
  derived and/or modified sequence opt2 from neuraminidase__InfluenzaA__AFJ78764

SEQ ID NO: 113888 - RNA, 1410 nt, Artificial Sequence; identical to SEQ ID NO: 108250
  derived and/or modified sequence opt2 from neuraminidase__InfluenzaA__AFJ78774

SEQ ID NO: 113889 - RNA, 1410 nt, Artificial Sequence; identical to SEQ ID NO: 108250
  derived and/or modified sequence opt2 from neuraminidase__InfluenzaA__AFJ78784

SEQ ID NO: 113890 - RNA, 1410 nt, Artificial Sequence
  derived and/or modified sequence opt2 from neuraminidase__InfluenzaA__AFJ78794
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113891 - RNA, 1410 nt, Artificial Sequence; identical to SEQ ID NO: 108250
  derived and/or modified sequence opt2 from neuraminidase__InfluenzaA__AFJ78804

SEQ ID NO: 113892 - RNA, 1410 nt, Artificial Sequence; identical to SEQ ID NO: 108250
  derived and/or modified sequence opt2 from neuraminidase__InfluenzaA__AFJ78814

SEQ ID NO: 113893 - RNA, 1410 nt, Artificial Sequence; identical to SEQ ID NO: 108250
  derived and/or modified sequence opt2 from neuraminidase__InfluenzaA__AFJ78824

SEQ ID NO: 113894 - RNA, 1410 nt, Artificial Sequence; identical to SEQ ID NO: 108250
  derived and/or modified sequence opt2 from neuraminidase__InfluenzaA__AFJ78834

SEQ ID NO: 113895 - RNA, 1410 nt, Artificial Sequence; identical to SEQ ID NO: 108250
  derived and/or modified sequence opt2 from neuraminidase__InfluenzaA__AFJ78844

SEQ ID NO: 113896 - RNA, 1410 nt, Artificial Sequence; identical to SEQ ID NO: 110499
  derived and/or modified sequence opt2 from neuraminidase__InfluenzaA__AFJ78854

SEQ ID NO: 113897 - RNA, 1410 nt, Artificial Sequence; identical to SEQ ID NO: 108250
  derived and/or modified sequence opt2 from neuraminidase__InfluenzaA__AFJ78864

SEQ ID NO: 113898 - RNA, 1410 nt, Artificial Sequence; identical to SEQ ID NO: 108250
  derived and/or modified sequence opt2 from neuraminidase__InfluenzaA__AFJ78874

SEQ ID NO: 113899 - RNA, 1410 nt, Artificial Sequence; identical to SEQ ID NO: 108250
  derived and/or modified sequence opt2 from neuraminidase__InfluenzaA__AFJ78884

SEQ ID NO: 113900 - RNA, 1410 nt, Artificial Sequence; identical to SEQ ID NO: 108250
  derived and/or modified sequence opt2 from neuraminidase__InfluenzaA__AFJ78894

SEQ ID NO: 113901 - RNA, 1410 nt, Artificial Sequence; identical to SEQ ID NO: 108250
  derived and/or modified sequence opt2 from neuraminidase__InfluenzaA__AFJ78904

SEQ ID NO: 113902 - RNA, 1410 nt, Artificial Sequence; identical to SEQ ID NO: 108250
  derived and/or modified sequence opt2 from neuraminidase__InfluenzaA__AFJ78914

SEQ ID NO: 113903 - RNA, 1410 nt, Artificial Sequence
  derived and/or modified sequence opt2 from neuraminidase__InfluenzaA__AFJ78924
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucgacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagauccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113904 - RNA, 1410 nt, Artificial Sequence
  derived and/or modified sequence opt2 from neuraminidase__InfluenzaA__AFJ97569
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacgagaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucuccugguccuggcccgacggcgccgagcuccccuucaccaucgacaaguga

SEQ ID NO: 113905 - RNA, 1410 nt, Artificial Sequence; identical to SEQ ID NO: 108240
  derived and/or modified sequence opt2 from neuraminidase__InfluenzaA__AFK14107

SEQ ID NO: 113906 - RNA, 1410 nt, Artificial Sequence; identical to SEQ ID NO: 108250
  derived and/or modified sequence opt2 from neuraminidase__InfluenzaA__AFK14117

SEQ ID NO: 113907 - RNA, 1410 nt, Artificial Sequence; identical to SEQ ID NO: 109017
  derived and/or modified sequence opt2 from neuraminidase__InfluenzaA__AFK14141

SEQ ID NO: 113908 - RNA, 1410 nt, Artificial Sequence
  derived and/or modified sequence opt2 from neuraminidase__InfluenzaA__AFK14150
augaaccccaaccagaagaucaucaccaucggcuccgucugcaugaccaucggcauggccaaccucauccuccagaucggcaacaucaucuccaucuggaucucccacuccauccgccucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacgagcaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113909 - RNA, 1410 nt, Artificial Sequence; identical to SEQ ID NO: 108833
  derived and/or modified sequence opt2 from neuraminidase__InfluenzaA__AFK14159

SEQ ID NO: 113910 - RNA, 1410 nt, Artificial Sequence; identical to SEQ ID NO: 108250
  derived and/or modified sequence opt2 from neuraminidase__InfluenzaA__AFK14168

SEQ ID NO: 113911 - RNA, 1410 nt, Artificial Sequence; identical to SEQ ID NO: 108250
  derived and/or modified sequence opt2 from neuraminidase__InfluenzaA__AFK14177

SEQ ID NO: 113912 - RNA, 1410 nt, Artificial Sequence
  derived and/or modified sequence opt2 from neuraminidase__InfluenzaA__AFK14186
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuucgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113913 - RNA, 1410 nt, Artificial Sequence; identical to SEQ ID NO: 110231
  derived and/or modified sequence opt2 from neuraminidase__InfluenzaA__AFK14195

SEQ ID NO: 113914 - RNA, 1410 nt, Artificial Sequence; identical to SEQ ID NO: 108250
  derived and/or modified sequence opt2 from neuraminidase__InfluenzaA__AFK14204

SEQ ID NO: 113915 - RNA, 1410 nt, Artificial Sequence; identical to SEQ ID NO: 110231
  derived and/or modified sequence opt2 from neuraminidase__InfluenzaA__AFK14213

SEQ ID NO: 113916 - RNA, 1410 nt, Artificial Sequence
  derived and/or modified sequence opt2 from neuraminidase__InfluenzaA__AFK14222
augaaccccaaccagaagaucaucaccaucggcuccgucugcaugaccaucggcauggccaaccucauccuccagaucggcaacaucaucuccaucuggaucucccacuccauccgccucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113917 - RNA, 1410 nt, Artificial Sequence; identical to SEQ ID NO: 108833
  derived and/or modified sequence opt2 from neuraminidase__InfluenzaA__AFK14231

SEQ ID NO: 113918 - RNA, 1410 nt, Artificial Sequence; identical to SEQ ID NO: 108250
  derived and/or modified sequence opt2 from neuraminidase__InfluenzaA__AFK14240

SEQ ID NO: 113919 - RNA, 1410 nt, Artificial Sequence; identical to SEQ ID NO: 109017
  derived and/or modified sequence opt2 from neuraminidase__InfluenzaA__AFK14249

SEQ ID NO: 113920 - RNA, 1410 nt, Artificial Sequence; identical to SEQ ID NO: 108250
  derived and/or modified sequence opt2 from neuraminidase__InfluenzaA__AFK14257

SEQ ID NO: 113921 - RNA, 1410 nt, Artificial Sequence; identical to SEQ ID NO: 108250
  derived and/or modified sequence opt2 from neuraminidase__InfluenzaA__AFK14266

SEQ ID NO: 113922 - RNA, 1410 nt, Artificial Sequence; identical to SEQ ID NO: 108250
  derived and/or modified sequence opt2 from neuraminidase__InfluenzaA__AFK14274

SEQ ID NO: 113923 - RNA, 1410 nt, Artificial Sequence
  derived and/or modified sequence opt2 from neuraminidase__InfluenzaA__AFK14281
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccgacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113924 - RNA, 1410 nt, Artificial Sequence; identical to SEQ ID NO: 108250
  derived and/or modified sequence opt2 from neuraminidase__InfluenzaA__AFK14289

SEQ ID NO: 113925 - RNA, 1410 nt, Artificial Sequence; identical to SEQ ID NO: 108833
  derived and/or modified sequence opt2 from neuraminidase__InfluenzaA__AFK14298

SEQ ID NO: 113926 - RNA, 1410 nt, Artificial Sequence; identical to SEQ ID NO: 108250
  derived and/or modified sequence opt2 from neuraminidase__InfluenzaA__AFK14307

SEQ ID NO: 113927 - RNA, 1410 nt, Artificial Sequence; identical to SEQ ID NO: 110231
  derived and/or modified sequence opt2 from neuraminidase__InfluenzaA__AFK14316

SEQ ID NO: 113928 - RNA, 1410 nt, Artificial Sequence
  derived and/or modified sequence opt2 from neuraminidase__InfluenzaA__AFK14325
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagcgcggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113929 - RNA, 1410 nt, Artificial Sequence; identical to SEQ ID NO: 108250
  derived and/or modified sequence opt2 from neuraminidase__InfluenzaA__AFK14334

SEQ ID NO: 113930 - RNA, 1410 nt, Artificial Sequence; identical to SEQ ID NO: 108250
  derived and/or modified sequence opt2 from neuraminidase__InfluenzaA__AFK14343

SEQ ID NO: 113931 - RNA, 1410 nt, Artificial Sequence; identical to SEQ ID NO: 108250
  derived and/or modified sequence opt2 from neuraminidase__InfluenzaA__AFK14352

SEQ ID NO: 113932 - RNA, 1410 nt, Artificial Sequence; identical to SEQ ID NO: 108250
  derived and/or modified sequence opt2 from neuraminidase__InfluenzaA__AFK14360

SEQ ID NO: 113933 - RNA, 1410 nt, Artificial Sequence; identical to SEQ ID NO: 108250
  derived and/or modified sequence opt2 from neuraminidase__InfluenzaA__AFK14369

SEQ ID NO: 113934 - RNA, 1410 nt, Artificial Sequence
  derived and/or modified sequence opt2 from neuraminidase__InfluenzaA__AFK14387
augaaccccaaccagaagaucaucaccaucggcuccgucugcaugaccaucggcauggccaaccucauccuccagaucggcaacaucaccuccaucuggaucucccacuccauccagcucggcaaccagaaccagaucgacaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113935 - RNA, 1410 nt, Artificial Sequence; identical to SEQ ID NO: 108833
  derived and/or modified sequence opt2 from neuraminidase__InfluenzaA__AFK14397

SEQ ID NO: 113936 - RNA, 1410 nt, Artificial Sequence; identical to SEQ ID NO: 108250
  derived and/or modified sequence opt2 from neuraminidase__InfluenzaA__AFK14406

SEQ ID NO: 113937 - RNA, 1410 nt, Artificial Sequence; identical to SEQ ID NO: 108250
  derived and/or modified sequence opt2 from neuraminidase__InfluenzaA__AFK14415

SEQ ID NO: 113938 - RNA, 1410 nt, Artificial Sequence; identical to SEQ ID NO: 108250
  derived and/or modified sequence opt2 from neuraminidase__InfluenzaA__AFK14424

SEQ ID NO: 113939 - RNA, 1410 nt, Artificial Sequence
  derived and/or modified sequence opt2 from neuraminidase__InfluenzaA__AFK14433
augaaccccaaccagaagaucaucaccaucggcuccgucugcaugaucaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113940 - RNA, 1410 nt, Artificial Sequence; identical to SEQ ID NO: 108250
  derived and/or modified sequence opt2 from neuraminidase__InfluenzaA__AFK14442

SEQ ID NO: 113941 - RNA, 1410 nt, Artificial Sequence
  derived and/or modified sequence opt2 from neuraminidase__InfluenzaA__AFK14451
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgccaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 113942 - RNA, 1410 nt, Artificial Sequence; identical to SEQ ID NO: 108250
  derived and/or modified sequence opt2 from neuraminidase__InfluenzaA__AFK14458

SEQ ID NO: 113943 - RNA, 1410 nt, Artificial Sequence; identical to SEQ ID NO: 108250
  derived and/or modified sequence opt2 from neuraminidase__InfluenzaA__AFK14467

SEQ ID NO: 113944 - RNA, 1410 nt, Artificial Sequence; identical to SEQ ID NO: 108250
  derived and/or modified sequence opt2 from neuraminidase__InfluenzaA__AFK14476

SEQ ID NO: 113945 - RNA, 1410 nt, Artificial Sequence; identical to SEQ ID NO: 111309
  derived and/or modified sequence opt2 from neuraminidase__InfluenzaA__AFK14485

SEQ ID NO: 113946 - RNA, 1410 nt, Artificial Sequence; identical to SEQ ID NO: 108250
  derived and/or modified sequence opt2 from neuraminidase__InfluenzaA__AFK14504

SEQ ID NO: 113947 - RNA, 1410 nt, Artificial Sequence; identical to SEQ ID NO: 108250
  derived and/or modified sequence opt2 from neuraminidase__InfluenzaA__AFK14514

SEQ ID NO: 113948 - RNA, 1410 nt, Artificial Sequence; identical to SEQ ID NO: 108250
  derived and/or modified sequence opt2 from neuraminidase__InfluenzaA__AFK14522

SEQ ID NO: 113949 - RNA, 1410 nt, Artificial Sequence; identical to SEQ ID NO: 108250
  derived and/or modified sequence opt2 from neuraminidase__InfluenzaA__AFK14529

SEQ ID NO: 113950 - RNA, 1410 nt, Artificial Sequence; identical to SEQ ID NO: 108250
  derived and/or modified sequence opt2 from neuraminidase__InfluenzaA__AFK14538

SEQ ID NO: 113951 - RNA, 1410 nt, Artificial Sequence; identical to SEQ ID NO: 110625
  derived and/or modified sequence opt2 from neuraminidase__InfluenzaA__AFK14547

SEQ ID NO: 113952 - RNA, 1410 nt, Artificial Sequence
  derived and/or modified sequence opt2 from neuraminidase__InfluenzaA__AFK14555
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucaucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113953 - RNA, 1410 nt, Artificial Sequence; identical to SEQ ID NO: 108250
  derived and/or modified sequence opt2 from neuraminidase__InfluenzaA__AFK14564

SEQ ID NO: 113954 - RNA, 1410 nt, Artificial Sequence; identical to SEQ ID NO: 108250
  derived and/or modified sequence opt2 from neuraminidase__InfluenzaA__AFK14573

SEQ ID NO: 113955 - RNA, 1410 nt, Artificial Sequence
  derived and/or modified sequence opt2 from neuraminidase__InfluenzaA__AFK14579
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaugugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113956 - RNA, 1410 nt, Artificial Sequence; identical to SEQ ID NO: 108250
  derived and/or modified sequence opt2 from neuraminidase__InfluenzaA__AFK14588

SEQ ID NO: 113957 - RNA, 1410 nt, Artificial Sequence; identical to SEQ ID NO: 108250
  derived and/or modified sequence opt2 from neuraminidase__InfluenzaA__AFK14597

SEQ ID NO: 113958 - RNA, 1410 nt, Artificial Sequence; identical to SEQ ID NO: 108250
  derived and/or modified sequence opt2 from neuraminidase__InfluenzaA__AFK14604

SEQ ID NO: 113959 - RNA, 1410 nt, Artificial Sequence; identical to SEQ ID NO: 108250
  derived and/or modified sequence opt2 from neuraminidase__InfluenzaA__AFK14632

SEQ ID NO: 113960 - RNA, 1410 nt, Artificial Sequence; identical to SEQ ID NO: 108240
  derived and/or modified sequence opt2 from neuraminidase__InfluenzaA__AFK14641

SEQ ID NO: 113961 - RNA, 1410 nt, Artificial Sequence; identical to SEQ ID NO: 108250
  derived and/or modified sequence opt2 from neuraminidase__InfluenzaA__AFK14651

SEQ ID NO: 113962 - RNA, 1410 nt, Artificial Sequence; identical to SEQ ID NO: 108250
  derived and/or modified sequence opt2 from neuraminidase__InfluenzaA__AFK14656

SEQ ID NO: 113963 - RNA, 1410 nt, Artificial Sequence; identical to SEQ ID NO: 108250
  derived and/or modified sequence opt2 from neuraminidase__InfluenzaA__AFK14663

SEQ ID NO: 113964 - RNA, 1410 nt, Artificial Sequence; identical to SEQ ID NO: 108250
  derived and/or modified sequence opt2 from neuraminidase__InfluenzaA__AFK14672

SEQ ID NO: 113965 - RNA, 1410 nt, Artificial Sequence; identical to SEQ ID NO: 108250
  derived and/or modified sequence opt2 from neuraminidase__InfluenzaA__AFK14680

SEQ ID NO: 113966 - RNA, 1410 nt, Artificial Sequence; identical to SEQ ID NO: 108250
  derived and/or modified sequence opt2 from neuraminidase__InfluenzaA__AFK14690

SEQ ID NO: 113967 - RNA, 1410 nt, Artificial Sequence; identical to SEQ ID NO: 108250
  derived and/or modified sequence opt2 from neuraminidase__InfluenzaA__AFK14707

SEQ ID NO: 113968 - RNA, 1410 nt, Artificial Sequence; identical to SEQ ID NO: 108250
  derived and/or modified sequence opt2 from neuraminidase__InfluenzaA__AFK14715

SEQ ID NO: 113969 - RNA, 1410 nt, Artificial Sequence; identical to SEQ ID NO: 108250
  derived and/or modified sequence opt2 from neuraminidase__InfluenzaA__AFK14724

SEQ ID NO: 113970 - RNA, 1410 nt, Artificial Sequence; identical to SEQ ID NO: 108250
  derived and/or modified sequence opt2 from neuraminidase__InfluenzaA__AFK14733

SEQ ID NO: 113971 - RNA, 1410 nt, Artificial Sequence; identical to SEQ ID NO: 108250
  derived and/or modified sequence opt2 from neuraminidase__InfluenzaA__AFK14751

SEQ ID NO: 113972 - RNA, 1410 nt, Artificial Sequence; identical to SEQ ID NO: 108250
  derived and/or modified sequence opt2 from neuraminidase__InfluenzaA__AFK14757

SEQ ID NO: 113973 - RNA, 1410 nt, Artificial Sequence; identical to SEQ ID NO: 108250
  derived and/or modified sequence opt2 from neuraminidase__InfluenzaA__AFK14766

SEQ ID NO: 113974 - RNA, 1410 nt, Artificial Sequence; identical to SEQ ID NO: 108833
  derived and/or modified sequence opt2 from neuraminidase__InfluenzaA__AFK14774

SEQ ID NO: 113975 - RNA, 1410 nt, Artificial Sequence; identical to SEQ ID NO: 113952
  derived and/or modified sequence opt2 from neuraminidase__InfluenzaA__AFK14781

SEQ ID NO: 113976 - RNA, 1410 nt, Artificial Sequence; identical to SEQ ID NO: 108833
  derived and/or modified sequence opt2 from neuraminidase__InfluenzaA__AFK14790

SEQ ID NO: 113977 - RNA, 1410 nt, Artificial Sequence
  derived and/or modified sequence opt2 from neuraminidase__InfluenzaA__AFK14800
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgcccccgcgagaacaccaucuggaccuccggcuccuccaucuccuucugcggcgucaacuccgacaccgucggcugguccuggcccgacggcgccgagcuccccuucaccaucgacaaguga

SEQ ID NO: 113978 - RNA, 1410 nt, Artificial Sequence; identical to SEQ ID NO: 110231
  derived and/or modified sequence opt2 from neuraminidase__InfluenzaA__AFK14809

SEQ ID NO: 113979 - RNA, 1410 nt, Artificial Sequence; identical to SEQ ID NO: 110231
  derived and/or modified sequence opt2 from neuraminidase__InfluenzaA__AFK14816

SEQ ID NO: 113980 - RNA, 1410 nt, Artificial Sequence; identical to SEQ ID NO: 108250
  derived and/or modified sequence opt2 from neuraminidase__InfluenzaA__AFK14824

SEQ ID NO: 113981 - RNA, 1410 nt, Artificial Sequence; identical to SEQ ID NO: 108250
  derived and/or modified sequence opt2 from neuraminidase__InfluenzaA__AFK14841

SEQ ID NO: 113982 - RNA, 1410 nt, Artificial Sequence; identical to SEQ ID NO: 109323
  derived and/or modified sequence opt2 from neuraminidase__InfluenzaA__AFK14849

SEQ ID NO: 113983 - RNA, 1410 nt, Artificial Sequence
  derived and/or modified sequence opt2 from neuraminidase__InfluenzaA__AFK14856
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaucgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113984 - RNA, 1410 nt, Artificial Sequence; identical to SEQ ID NO: 108250
  derived and/or modified sequence opt2 from neuraminidase__InfluenzaA__AFK14870

SEQ ID NO: 113985 - RNA, 1410 nt, Artificial Sequence; identical to SEQ ID NO: 108250
  derived and/or modified sequence opt2 from neuraminidase__InfluenzaA__AFK14879

SEQ ID NO: 113986 - RNA, 1410 nt, Artificial Sequence; identical to SEQ ID NO: 108250
  derived and/or modified sequence opt2 from neuraminidase__InfluenzaA__AFK14885

SEQ ID NO: 113987 - RNA, 1410 nt, Artificial Sequence; identical to SEQ ID NO: 108250
  derived and/or modified sequence opt2 from neuraminidase__InfluenzaA__AFK14894

SEQ ID NO: 113988 - RNA, 1410 nt, Artificial Sequence; identical to SEQ ID NO: 108250
  derived and/or modified sequence opt2 from neuraminidase__InfluenzaA__AFK14903

SEQ ID NO: 113989 - RNA, 1410 nt, Artificial Sequence; identical to SEQ ID NO: 108250
  derived and/or modified sequence opt2 from neuraminidase__InfluenzaA__AFK14912

SEQ ID NO: 113990 - RNA, 1410 nt, Artificial Sequence; identical to SEQ ID NO: 108250
  derived and/or modified sequence opt2 from neuraminidase__InfluenzaA__AFK14921

SEQ ID NO: 113991 - RNA, 1410 nt, Artificial Sequence; identical to SEQ ID NO: 108250
  derived and/or modified sequence opt2 from neuraminidase__InfluenzaA__AFK14931

SEQ ID NO: 113992 - RNA, 1410 nt, Artificial Sequence
  derived and/or modified sequence opt2 from neuraminidase__InfluenzaA__AFK25604
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113993 - RNA, 1410 nt, Artificial Sequence; identical to SEQ ID NO: 113992
  derived and/or modified sequence opt2 from neuraminidase__InfluenzaA__AFK25606

SEQ ID NO: 113994 - RNA, 1410 nt, Artificial Sequence; identical to SEQ ID NO: 109601
  derived and/or modified sequence opt2 from neuraminidase__InfluenzaA__AFK74537

SEQ ID NO: 113995 - RNA, 1410 nt, Artificial Sequence; identical to SEQ ID NO: 108250
  derived and/or modified sequence opt2 from neuraminidase__InfluenzaA__AFK74547

SEQ ID NO: 113996 - RNA, 1410 nt, Artificial Sequence; identical to SEQ ID NO: 111242
  derived and/or modified sequence opt2 from neuraminidase__InfluenzaA__AFK74557

SEQ ID NO: 113997 - RNA, 1410 nt, Artificial Sequence; identical to SEQ ID NO: 108250
  derived and/or modified sequence opt2 from neuraminidase__InfluenzaA__AFK74567

SEQ ID NO: 113998 - RNA, 1410 nt, Artificial Sequence; identical to SEQ ID NO: 108250
  derived and/or modified sequence opt2 from neuraminidase__InfluenzaA__AFK74578

SEQ ID NO: 113999 - RNA, 1410 nt, Artificial Sequence; identical to SEQ ID NO: 113365
  derived and/or modified sequence opt2 from neuraminidase__InfluenzaA__AFK74588

SEQ ID NO: 114000 - RNA, 1410 nt, Artificial Sequence; identical to SEQ ID NO: 108250
  derived and/or modified sequence opt2 from neuraminidase__InfluenzaA__AFK74598

SEQ ID NO: 114001 - RNA, 1410 nt, Artificial Sequence; identical to SEQ ID NO: 108250
  derived and/or modified sequence opt2 from neuraminidase__InfluenzaA__AFK74608

SEQ ID NO: 114002 - RNA, 1410 nt, Artificial Sequence; identical to SEQ ID NO: 108250
  derived and/or modified sequence opt2 from neuraminidase__InfluenzaA__AFK74618

SEQ ID NO: 114003 - RNA, 1410 nt, Artificial Sequence; identical to SEQ ID NO: 108250
  derived and/or modified sequence opt2 from neuraminidase__InfluenzaA__AFK74628

SEQ ID NO: 114004 - RNA, 1410 nt, Artificial Sequence; identical to SEQ ID NO: 108250
  derived and/or modified sequence opt2 from neuraminidase__InfluenzaA__AFK74638

SEQ ID NO: 114005 - RNA, 1410 nt, Artificial Sequence; identical to SEQ ID NO: 108250
  derived and/or modified sequence opt2 from neuraminidase__InfluenzaA__AFK74648

SEQ ID NO: 114006 - RNA, 1410 nt, Artificial Sequence; identical to SEQ ID NO: 113374
  derived and/or modified sequence opt2 from neuraminidase__InfluenzaA__AFK74658

SEQ ID NO: 114007 - RNA, 1410 nt, Artificial Sequence; identical to SEQ ID NO: 113374
  derived and/or modified sequence opt2 from neuraminidase__InfluenzaA__AFK74668

SEQ ID NO: 114008 - RNA, 1410 nt, Artificial Sequence; identical to SEQ ID NO: 108250
  derived and/or modified sequence opt2 from neuraminidase__InfluenzaA__AFK74678

SEQ ID NO: 114009 - RNA, 1410 nt, Artificial Sequence; identical to SEQ ID NO: 108250
  derived and/or modified sequence opt2 from neuraminidase__InfluenzaA__AFK74688

SEQ ID NO: 114010 - RNA, 1410 nt, Artificial Sequence; identical to SEQ ID NO: 108250
  derived and/or modified sequence opt2 from neuraminidase__InfluenzaA__AFK74698

SEQ ID NO: 114011 - RNA, 1410 nt, Artificial Sequence; identical to SEQ ID NO: 113381
  derived and/or modified sequence opt2 from neuraminidase__InfluenzaA__AFK74708

SEQ ID NO: 114012 - RNA, 1410 nt, Artificial Sequence; identical to SEQ ID NO: 111242
  derived and/or modified sequence opt2 from neuraminidase__InfluenzaA__AFK74718

SEQ ID NO: 114013 - RNA, 1410 nt, Artificial Sequence; identical to SEQ ID NO: 108250
  derived and/or modified sequence opt2 from neuraminidase__InfluenzaA__AFK74728

SEQ ID NO: 114014 - RNA, 1410 nt, Artificial Sequence; identical to SEQ ID NO: 108250
  derived and/or modified sequence opt2 from neuraminidase__InfluenzaA__AFK74738

SEQ ID NO: 114015 - RNA, 1410 nt, Artificial Sequence; identical to SEQ ID NO: 108250
  derived and/or modified sequence opt2 from neuraminidase__InfluenzaA__AFK74748

SEQ ID NO: 114016 - RNA, 1410 nt, Artificial Sequence; identical to SEQ ID NO: 108250
  derived and/or modified sequence opt2 from neuraminidase__InfluenzaA__AFK74758

SEQ ID NO: 114017 - RNA, 1410 nt, Artificial Sequence; identical to SEQ ID NO: 108250
  derived and/or modified sequence opt2 from neuraminidase__InfluenzaA__AFK74768

SEQ ID NO: 114018 - RNA, 1410 nt, Artificial Sequence; identical to SEQ ID NO: 108250
  derived and/or modified sequence opt2 from neuraminidase__InfluenzaA__AFK74778

SEQ ID NO: 114019 - RNA, 1410 nt, Artificial Sequence; identical to SEQ ID NO: 111242
  derived and/or modified sequence opt2 from neuraminidase__InfluenzaA__AFK74788

SEQ ID NO: 114020 - RNA, 1410 nt, Artificial Sequence; identical to SEQ ID NO: 111242
  derived and/or modified sequence opt2 from neuraminidase__InfluenzaA__AFK74798

SEQ ID NO: 114021 - RNA, 1410 nt, Artificial Sequence; identical to SEQ ID NO: 111242
  derived and/or modified sequence opt2 from neuraminidase__InfluenzaA__AFK74808

SEQ ID NO: 114022 - RNA, 1410 nt, Artificial Sequence; identical to SEQ ID NO: 111242
  derived and/or modified sequence opt2 from neuraminidase__InfluenzaA__AFK74818

SEQ ID NO: 114023 - RNA, 1410 nt, Artificial Sequence; identical to SEQ ID NO: 108250
  derived and/or modified sequence opt2 from neuraminidase__InfluenzaA__AFK74828

SEQ ID NO: 114024 - RNA, 1410 nt, Artificial Sequence; identical to SEQ ID NO: 110141
  derived and/or modified sequence opt2 from neuraminidase__InfluenzaA__AFK74838

SEQ ID NO: 114025 - RNA, 1410 nt, Artificial Sequence; identical to SEQ ID NO: 108250
  derived and/or modified sequence opt2 from neuraminidase__InfluenzaA__AFK74848

SEQ ID NO: 114026 - RNA, 1410 nt, Artificial Sequence; identical to SEQ ID NO: 108250
  derived and/or modified sequence opt2 from neuraminidase__InfluenzaA__AFK74898

SEQ ID NO: 114027 - RNA, 1410 nt, Artificial Sequence; identical to SEQ ID NO: 108250
  derived and/or modified sequence opt2 from neuraminidase__InfluenzaA__AFK74908

SEQ ID NO: 114028 - RNA, 1410 nt, Artificial Sequence; identical to SEQ ID NO: 108250
  derived and/or modified sequence opt2 from neuraminidase__InfluenzaA__AFK74918

SEQ ID NO: 114029 - RNA, 1410 nt, Artificial Sequence; identical to SEQ ID NO: 108250
  derived and/or modified sequence opt2 from neuraminidase__InfluenzaA__AFK74928

SEQ ID NO: 114030 - RNA, 1410 nt, Artificial Sequence
  derived and/or modified sequence opt2 from neuraminidase__InfluenzaA__AFK74938
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaacaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114031 - RNA, 1410 nt, Artificial Sequence; identical to SEQ ID NO: 108250
  derived and/or modified sequence opt2 from neuraminidase__InfluenzaA__AFK74948

SEQ ID NO: 114032 - RNA, 1410 nt, Artificial Sequence; identical to SEQ ID NO: 110141
  derived and/or modified sequence opt2 from neuraminidase__InfluenzaA__AFK74958

SEQ ID NO: 114033 - RNA, 1410 nt, Artificial Sequence; identical to SEQ ID NO: 111242
  derived and/or modified sequence opt2 from neuraminidase__InfluenzaA__AFK74968

SEQ ID NO: 114034 - RNA, 1410 nt, Artificial Sequence; identical to SEQ ID NO: 108250
  derived and/or modified sequence opt2 from neuraminidase__InfluenzaA__AFK74978

SEQ ID NO: 114035 - RNA, 1410 nt, Artificial Sequence; identical to SEQ ID NO: 110141
  derived and/or modified sequence opt2 from neuraminidase__InfluenzaA__AFK74988

SEQ ID NO: 114036 - RNA, 1410 nt, Artificial Sequence; identical to SEQ ID NO: 108250
  derived and/or modified sequence opt2 from neuraminidase__InfluenzaA__AFK74998

SEQ ID NO: 114037 - RNA, 1410 nt, Artificial Sequence; identical to SEQ ID NO: 111242
  derived and/or modified sequence opt2 from neuraminidase__InfluenzaA__AFK75008

SEQ ID NO: 114038 - RNA, 1410 nt, Artificial Sequence; identical to SEQ ID NO: 108250
  derived and/or modified sequence opt2 from neuraminidase__InfluenzaA__AFK75018

SEQ ID NO: 114039 - RNA, 1410 nt, Artificial Sequence; identical to SEQ ID NO: 108250
  derived and/or modified sequence opt2 from neuraminidase__InfluenzaA__AFK75028

SEQ ID NO: 114040 - RNA, 1410 nt, Artificial Sequence; identical to SEQ ID NO: 108250
  derived and/or modified sequence opt2 from neuraminidase__InfluenzaA__AFK75038

SEQ ID NO: 114041 - RNA, 1410 nt, Artificial Sequence; identical to SEQ ID NO: 108250
  derived and/or modified sequence opt2 from neuraminidase__InfluenzaA__AFK75048

SEQ ID NO: 114042 - RNA, 1410 nt, Artificial Sequence; identical to SEQ ID NO: 108250
  derived and/or modified sequence opt2 from neuraminidase__InfluenzaA__AFK75058

SEQ ID NO: 114043 - RNA, 1410 nt, Artificial Sequence; identical to SEQ ID NO: 111242
  derived and/or modified sequence opt2 from neuraminidase__InfluenzaA__AFK75068

SEQ ID NO: 114044 - RNA, 1410 nt, Artificial Sequence; identical to SEQ ID NO: 108250
  derived and/or modified sequence opt2 from neuraminidase__InfluenzaA__AFK75078

SEQ ID NO: 114045 - RNA, 1410 nt, Artificial Sequence; identical to SEQ ID NO: 108250
  derived and/or modified sequence opt2 from neuraminidase__InfluenzaA__AFK75088

SEQ ID NO: 114046 - RNA, 1410 nt, Artificial Sequence; identical to SEQ ID NO: 108250
  derived and/or modified sequence opt2 from neuraminidase__InfluenzaA__AFK75098

SEQ ID NO: 114047 - RNA, 1410 nt, Artificial Sequence; identical to SEQ ID NO: 110163
  derived and/or modified sequence opt2 from neuraminidase__InfluenzaA__AFK75108

SEQ ID NO: 114048 - RNA, 1410 nt, Artificial Sequence; identical to SEQ ID NO: 108250
  derived and/or modified sequence opt2 from neuraminidase__InfluenzaA__AFK77860

SEQ ID NO: 114049 - RNA, 1410 nt, Artificial Sequence; identical to SEQ ID NO: 108250
  derived and/or modified sequence opt2 from neuraminidase__InfluenzaA__AFK77870

SEQ ID NO: 114050 - RNA, 1410 nt, Artificial Sequence; identical to SEQ ID NO: 108250
  derived and/or modified sequence opt2 from neuraminidase__InfluenzaA__AFK77880

SEQ ID NO: 114051 - RNA, 1410 nt, Artificial Sequence
  derived and/or modified sequence opt2 from neuraminidase__InfluenzaA__AFK77890
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaagggcaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114052 - RNA, 1410 nt, Artificial Sequence
  derived and/or modified sequence opt2 from neuraminidase__InfluenzaA__AFK77900
augaaccccaaccagaagaucaucaccaucggcuccgucugcaugaccaucggcauggccaaccucauccuccagaucggcaacaucaucuccaucuggaucucccacuccauccagaucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcgcccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaugaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114053 - RNA, 1410 nt, Artificial Sequence
  derived and/or modified sequence opt2 from neuraminidase__InfluenzaA__AFK78031
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcgcccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaugaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114054 - RNA, 1410 nt, Artificial Sequence; identical to SEQ ID NO: 108250
  derived and/or modified sequence opt2 from neuraminidase__InfluenzaA__AFK78190

SEQ ID NO: 114055 - RNA, 1362 nt, Artificial Sequence
  derived and/or modified sequence opt2 from neuraminidase__InfluenzaA__AFM68957
augaaccccaaccagaagaucaucaccaucggcuccaucugcauggucgucggcaucaucucccucauccuccagaucggcaacaucaucuccaucuggaucucccacuccauccagaccggcaaccagaaccacaccggcaucugcaaccagggcaucaucacccacaacgucgucgccggccaggacuccaccuccgucauccucaccggcaacuccucccucugccccauccgcggcugggccauccacuccaaggacaacggcauccgcaucggcuccaagggcgacgucuucgucauccgcgagcccuucaucuccugcucccaccucgagugccgcaccuucuuccucacccagggcgcccuccucaacgacaagcacuccuacggcaccuccaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcaccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuccgccgacggcgccaacggcgucaagggcuucuccuaccgcuacggcaacggcgucuggaucggccgcaccaaguccgacuccucccgccacggcuucgagaugaucugggaccccaacggcuggaccgagaccgacucccgcuucuccguccgccaggacgucgucgccaugaccgaccgcuccggcuacuccggcuccuucguccagcaccccgagcucaccggccucgacugcaugcgccccugcuucugggucgagcucauccgcggccagcccgaggaggagaccaucuggaccuccggcuccaucaucuccuucugcggcgucaacuccgacaccgucgacugguccuggcccgacggcgccgagcuccccuucaccaucgacaaguga

SEQ ID NO: 114056 - RNA, 1410 nt, Artificial Sequence
  derived and/or modified sequence opt2 from neuraminidase__InfluenzaA__AFM68968
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgccuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 114057 - RNA, 1410 nt, Artificial Sequence
  derived and/or modified sequence opt2 from neuraminidase__InfluenzaA__AFM68979
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcggcaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 114058 - RNA, 1410 nt, Artificial Sequence; identical to SEQ ID NO: 114057
  derived and/or modified sequence opt2 from neuraminidase__InfluenzaA__AFM68990

SEQ ID NO: 114059 - RNA, 1410 nt, Artificial Sequence; identical to SEQ ID NO: 106325
  derived and/or modified sequence opt2 from neuraminidase__InfluenzaA__AFM71723

SEQ ID NO: 114060 - RNA, 1410 nt, Artificial Sequence; identical to SEQ ID NO: 113647
  derived and/or modified sequence opt2 from neuraminidase__InfluenzaA__AFM71734

SEQ ID NO: 114061 - RNA, 1410 nt, Artificial Sequence; identical to SEQ ID NO: 113461
  derived and/or modified sequence opt2 from neuraminidase__InfluenzaA__AFM71745

SEQ ID NO: 114062 - RNA, 1410 nt, Artificial Sequence; identical to SEQ ID NO: 110121
  derived and/or modified sequence opt2 from neuraminidase__InfluenzaA__AFM71771

SEQ ID NO: 114063 - RNA, 1410 nt, Artificial Sequence; identical to SEQ ID NO: 113147
  derived and/or modified sequence opt2 from neuraminidase__InfluenzaA__AFM71782

SEQ ID NO: 114064 - RNA, 1410 nt, Artificial Sequence; identical to SEQ ID NO: 113147
  derived and/or modified sequence opt2 from neuraminidase__InfluenzaA__AFM71794

SEQ ID NO: 114065 - RNA, 1410 nt, Artificial Sequence; identical to SEQ ID NO: 108111
  derived and/or modified sequence opt2 from neuraminidase__InfluenzaA__AFM71805

SEQ ID NO: 114066 - RNA, 1410 nt, Artificial Sequence
  derived and/or modified sequence opt2 from neuraminidase__InfluenzaA__AFM71827
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaaggacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114067 - RNA, 1410 nt, Artificial Sequence; identical to SEQ ID NO: 111030
  derived and/or modified sequence opt2 from neuraminidase__InfluenzaA__AFM71838

SEQ ID NO: 114068 - RNA, 1365 nt, Artificial Sequence; identical to SEQ ID NO: 107231
  derived and/or modified sequence opt2 from neuraminidase__InfluenzaA__AFM71849

SEQ ID NO: 114069 - RNA, 1410 nt, Artificial Sequence; identical to SEQ ID NO: 105607
  derived and/or modified sequence opt2 from neuraminidase__InfluenzaA__AFM71860

SEQ ID NO: 114070 - RNA, 1410 nt, Artificial Sequence; identical to SEQ ID NO: 105839
  derived and/or modified sequence opt2 from neuraminidase__InfluenzaA__AFM71871

SEQ ID NO: 114071 - RNA, 1410 nt, Artificial Sequence; identical to SEQ ID NO: 105839
  derived and/or modified sequence opt2 from neuraminidase__InfluenzaA__AFM71882

SEQ ID NO: 114072 - RNA, 1410 nt, Artificial Sequence
  derived and/or modified sequence opt2 from neuraminidase__InfluenzaA__AFM71893
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggagucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 114073 - RNA, 1410 nt, Artificial Sequence
  derived and/or modified sequence opt2 from neuraminidase__InfluenzaA__AFM71904
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgucaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccggcuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggagucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 114074 - RNA, 1410 nt, Artificial Sequence; identical to SEQ ID NO: 106484
  derived and/or modified sequence opt2 from neuraminidase__InfluenzaA__AFM71915

SEQ ID NO: 114075 - RNA, 1410 nt, Artificial Sequence; identical to SEQ ID NO: 106484
  derived and/or modified sequence opt2 from neuraminidase__InfluenzaA__AFM71926

SEQ ID NO: 114076 - RNA, 1410 nt, Artificial Sequence; identical to SEQ ID NO: 106484
  derived and/or modified sequence opt2 from neuraminidase__InfluenzaA__AFM71937

SEQ ID NO: 114077 - RNA, 1410 nt, Artificial Sequence; identical to SEQ ID NO: 113492
  derived and/or modified sequence opt2 from neuraminidase__InfluenzaA__AFM71948

SEQ ID NO: 114078 - RNA, 1410 nt, Artificial Sequence; identical to SEQ ID NO: 113492
  derived and/or modified sequence opt2 from neuraminidase__InfluenzaA__AFM71959

SEQ ID NO: 114079 - RNA, 1410 nt, Artificial Sequence
  derived and/or modified sequence opt2 from neuraminidase__InfluenzaA__AFM71970
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccuacgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgagaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgccaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 114080 - RNA, 1410 nt, Artificial Sequence; identical to SEQ ID NO: 113500
  derived and/or modified sequence opt2 from neuraminidase__InfluenzaA__AFM71981

SEQ ID NO: 114081 - RNA, 1410 nt, Artificial Sequence
  derived and/or modified sequence opt2 from neuraminidase__InfluenzaA__AFM71992
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccuggucccaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaugaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114082 - RNA, 1410 nt, Artificial Sequence; identical to SEQ ID NO: 114056
  derived and/or modified sequence opt2 from neuraminidase__InfluenzaA__AFM72013

SEQ ID NO: 114083 - RNA, 1365 nt, Artificial Sequence; identical to SEQ ID NO: 107231
  derived and/or modified sequence opt2 from neuraminidase__InfluenzaA__AFM72024

SEQ ID NO: 114084 - RNA, 1410 nt, Artificial Sequence; identical to SEQ ID NO: 110507
  derived and/or modified sequence opt2 from neuraminidase__InfluenzaA__AFM72035

SEQ ID NO: 114085 - RNA, 1410 nt, Artificial Sequence; identical to SEQ ID NO: 110507
  derived and/or modified sequence opt2 from neuraminidase__InfluenzaA__AFM72046

SEQ ID NO: 114086 - RNA, 1413 nt, Artificial Sequence
  derived and/or modified sequence opt2 from neuraminidase__InfluenzaA__AFM72057
augaaccccaaccagaagaucaucaccaucggcuccaucugcaccaccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 114087 - RNA, 1413 nt, Artificial Sequence; identical to SEQ ID NO: 106571
  derived and/or modified sequence opt2 from neuraminidase__InfluenzaA__AFM72068

SEQ ID NO: 114088 - RNA, 1410 nt, Artificial Sequence
  derived and/or modified sequence opt2 from neuraminidase__InfluenzaA__AFM72090
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgccucggcuacgagaccuucaaggucaucggcggcugguccacccccaacuccaagcuccagaucaaccgccaggucaucgucgacuccaagaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 114089 - RNA, 1410 nt, Artificial Sequence
  derived and/or modified sequence opt2 from neuraminidase__InfluenzaA__AFM72101
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggccaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 114090 - RNA, 1410 nt, Artificial Sequence; identical to SEQ ID NO: 106325
  derived and/or modified sequence opt2 from neuraminidase__InfluenzaA__AFM72112

SEQ ID NO: 114091 - RNA, 1410 nt, Artificial Sequence
  derived and/or modified sequence opt2 from neuraminidase__InfluenzaA__AFM72123
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaccaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 114092 - RNA, 1410 nt, Artificial Sequence; identical to SEQ ID NO: 113647
  derived and/or modified sequence opt2 from neuraminidase__InfluenzaA__AFM72134

SEQ ID NO: 114093 - RNA, 1410 nt, Artificial Sequence
  derived and/or modified sequence opt2 from neuraminidase__InfluenzaA__AFM72145
augaaccccaaccagaagaucaucaccaucggcuccgucucccucaccaucgccaccaucugcuuccucaugcagaucgccauccucgccaucaccgucacccuccacuucaagcaguacgagugcaacuccccccccaacaaccaggucaugcucugcgagcccaccaucaucgagcgcaacaccaccgagaucgucuaccucaccaacaccaccaucgagaaggaggucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 114094 - RNA, 1410 nt, Artificial Sequence; identical to SEQ ID NO: 106697
  derived and/or modified sequence opt2 from neuraminidase__InfluenzaA__AFM72156

SEQ ID NO: 114095 - RNA, 1410 nt, Artificial Sequence
  derived and/or modified sequence opt2 from neuraminidase__InfluenzaA__AFM72167
augaaccccaaccagaagaucaucaccaucggcuccaucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccgagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 114096 - RNA, 1410 nt, Artificial Sequence
  derived and/or modified sequence opt2 from neuraminidase__InfluenzaA__AFM72178
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccgagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 114097 - RNA, 1410 nt, Artificial Sequence
  derived and/or modified sequence opt2 from neuraminidase__InfluenzaA__AFM72189
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcgacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 114098 - RNA, 1410 nt, Artificial Sequence; identical to SEQ ID NO: 114097
  derived and/or modified sequence opt2 from neuraminidase__InfluenzaA__AFM72200

SEQ ID NO: 114099 - RNA, 1410 nt, Artificial Sequence; identical to SEQ ID NO: 107261
  derived and/or modified sequence opt2 from neuraminidase__InfluenzaA__AFM72211

SEQ ID NO: 114100 - RNA, 1410 nt, Artificial Sequence; identical to SEQ ID NO: 107261
  derived and/or modified sequence opt2 from neuraminidase__InfluenzaA__AFM72222

SEQ ID NO: 114101 - RNA, 1413 nt, Artificial Sequence; identical to SEQ ID NO: 107965
  derived and/or modified sequence opt2 from neuraminidase__InfluenzaA__AFM72233

SEQ ID NO: 114102 - RNA, 1410 nt, Artificial Sequence; identical to SEQ ID NO: 106085
  derived and/or modified sequence opt2 from neuraminidase__InfluenzaA__AFM72249

SEQ ID NO: 114103 - RNA, 1410 nt, Artificial Sequence; identical to SEQ ID NO: 105573
  derived and/or modified sequence opt2 from neuraminidase__InfluenzaA__AFM72260

SEQ ID NO: 114104 - RNA, 1410 nt, Artificial Sequence; identical to SEQ ID NO: 105573
  derived and/or modified sequence opt2 from neuraminidase__InfluenzaA__AFM72271

SEQ ID NO: 114105 - RNA, 1410 nt, Artificial Sequence
  derived and/or modified sequence opt2 from neuraminidase__InfluenzaA__AFM72293
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacuacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 114106 - RNA, 1410 nt, Artificial Sequence; identical to SEQ ID NO: 107441
  derived and/or modified sequence opt2 from neuraminidase__InfluenzaA__AFM72304

SEQ ID NO: 114107 - RNA, 1410 nt, Artificial Sequence
  derived and/or modified sequence opt2 from neuraminidase__InfluenzaA__AFM72315
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgagaagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 114108 - RNA, 1410 nt, Artificial Sequence
  derived and/or modified sequence opt2 from neuraminidase__InfluenzaA__AFM72326
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaaguuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 114109 - RNA, 1410 nt, Artificial Sequence
  derived and/or modified sequence opt2 from neuraminidase__InfluenzaA__AFM72337
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114110 - RNA, 1410 nt, Artificial Sequence
  derived and/or modified sequence opt2 from neuraminidase__InfluenzaA__AFM72348
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcauccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 114111 - RNA, 1410 nt, Artificial Sequence
  derived and/or modified sequence opt2 from neuraminidase__InfluenzaA__AFM72359
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgacaucaaccucaugcccaucuga

SEQ ID NO: 114112 - RNA, 1410 nt, Artificial Sequence; identical to SEQ ID NO: 114111
  derived and/or modified sequence opt2 from neuraminidase__InfluenzaA__AFM72370

SEQ ID NO: 114113 - RNA, 1410 nt, Artificial Sequence; identical to SEQ ID NO: 111030
  derived and/or modified sequence opt2 from neuraminidase__InfluenzaA__AFM72381

SEQ ID NO: 114114 - RNA, 1410 nt, Artificial Sequence; identical to SEQ ID NO: 111030
  derived and/or modified sequence opt2 from neuraminidase__InfluenzaA__AFM72392

SEQ ID NO: 114115 - RNA, 1410 nt, Artificial Sequence; identical to SEQ ID NO: 107914
  derived and/or modified sequence opt2 from neuraminidase__InfluenzaA__AFM72403

SEQ ID NO: 114116 - RNA, 1410 nt, Artificial Sequence; identical to SEQ ID NO: 107914
  derived and/or modified sequence opt2 from neuraminidase__InfluenzaA__AFM72414

SEQ ID NO: 114117 - RNA, 1410 nt, Artificial Sequence; identical to SEQ ID NO: 107578
  derived and/or modified sequence opt2 from neuraminidase__InfluenzaA__AFM72425

SEQ ID NO: 114118 - RNA, 1410 nt, Artificial Sequence; identical to SEQ ID NO: 107578
  derived and/or modified sequence opt2 from neuraminidase__InfluenzaA__AFM72436

SEQ ID NO: 114119 - RNA, 1410 nt, Artificial Sequence; identical to SEQ ID NO: 107578
  derived and/or modified sequence opt2 from neuraminidase__InfluenzaA__AFM72447

SEQ ID NO: 114120 - RNA, 1410 nt, Artificial Sequence; identical to SEQ ID NO: 107578
  derived and/or modified sequence opt2 from neuraminidase__InfluenzaA__AFM72458

SEQ ID NO: 114121 - RNA, 1410 nt, Artificial Sequence; identical to SEQ ID NO: 107578
  derived and/or modified sequence opt2 from neuraminidase__InfluenzaA__AFM72469

SEQ ID NO: 114122 - RNA, 1410 nt, Artificial Sequence
  derived and/or modified sequence opt2 from neuraminidase__InfluenzaA__AFM72491
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugaugugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114123 - RNA, 1410 nt, Artificial Sequence; identical to SEQ ID NO: 114122
  derived and/or modified sequence opt2 from neuraminidase__InfluenzaA__AFM72502

SEQ ID NO: 114124 - RNA, 1413 nt, Artificial Sequence; identical to SEQ ID NO: 108144
  derived and/or modified sequence opt2 from neuraminidase__InfluenzaA__AFM72513

SEQ ID NO: 114125 - RNA, 1413 nt, Artificial Sequence; identical to SEQ ID NO: 108144
  derived and/or modified sequence opt2 from neuraminidase__InfluenzaA__AFM72524

SEQ ID NO: 114126 - RNA, 1413 nt, Artificial Sequence; identical to SEQ ID NO: 108144
  derived and/or modified sequence opt2 from neuraminidase__InfluenzaA__AFM72535

SEQ ID NO: 114127 - RNA, 1413 nt, Artificial Sequence; identical to SEQ ID NO: 108144
  derived and/or modified sequence opt2 from neuraminidase__InfluenzaA__AFM72546

SEQ ID NO: 114128 - RNA, 1413 nt, Artificial Sequence; identical to SEQ ID NO: 108144
  derived and/or modified sequence opt2 from neuraminidase__InfluenzaA__AFM72557

SEQ ID NO: 114129 - RNA, 1410 nt, Artificial Sequence
  derived and/or modified sequence opt2 from neuraminidase__InfluenzaA__AFM72579
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccauccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114130 - RNA, 1413 nt, Artificial Sequence
  derived and/or modified sequence opt2 from neuraminidase__InfluenzaA__AFM72802
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaugugcaaccagcgcaucaucaccuacgagaacuccaccugggucaaccacaccuacgucaacaucaacaacaccaacgucgucgccggcaaggacaagacccccgucacccucgccggcaacuccucccucugcuccaucuccggcugggccauccacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaucaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaucgccaacugguccuggcccgacggcgccgagcuccccuucaccaucgacaaguga

SEQ ID NO: 114131 - RNA, 1413 nt, Artificial Sequence; identical to SEQ ID NO: 114130
  derived and/or modified sequence opt2 from neuraminidase__InfluenzaA__AFM72813

SEQ ID NO: 114132 - RNA, 1413 nt, Artificial Sequence; identical to SEQ ID NO: 114130
  derived and/or modified sequence opt2 from neuraminidase__InfluenzaA__AFM72824

SEQ ID NO: 114133 - RNA, 1410 nt, Artificial Sequence; identical to SEQ ID NO: 108240
  derived and/or modified sequence opt2 from neuraminidase__InfluenzaA__AFM72835

SEQ ID NO: 114134 - RNA, 1410 nt, Artificial Sequence; identical to SEQ ID NO: 108240
  derived and/or modified sequence opt2 from neuraminidase__InfluenzaA__AFM72845

SEQ ID NO: 114135 - RNA, 1410 nt, Artificial Sequence; identical to SEQ ID NO: 108240
  derived and/or modified sequence opt2 from neuraminidase__InfluenzaA__AFM72855

SEQ ID NO: 114136 - RNA, 1410 nt, Artificial Sequence; identical to SEQ ID NO: 108240
  derived and/or modified sequence opt2 from neuraminidase__InfluenzaA__AFM72865

SEQ ID NO: 114137 - RNA, 1410 nt, Artificial Sequence
  derived and/or modified sequence opt2 from neuraminidase__InfluenzaA__AFM72875
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaaguccgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 114138 - RNA, 1410 nt, Artificial Sequence; identical to SEQ ID NO: 108111
  derived and/or modified sequence opt2 from neuraminidase__InfluenzaA__AFM72886

SEQ ID NO: 114139 - RNA, 1410 nt, Artificial Sequence; identical to SEQ ID NO: 108111
  derived and/or modified sequence opt2 from neuraminidase__InfluenzaA__AFM72897

SEQ ID NO: 114140 - RNA, 1410 nt, Artificial Sequence
  derived and/or modified sequence opt2 from neuraminidase__InfluenzaA__AFM72908
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaccaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 114141 - RNA, 1410 nt, Artificial Sequence
  derived and/or modified sequence opt2 from neuraminidase__InfluenzaA__AFM72919
augaaccccaaccagaagaucaucaccaucggcuccgucucccucaccaucuccaccaucugcuucuucaugcagaucgccauccucaucaccaccgucacccuccacuucaagcagcacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaccaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 114142 - RNA, 1410 nt, Artificial Sequence; identical to SEQ ID NO: 109417
  derived and/or modified sequence opt2 from neuraminidase__InfluenzaA__AFM72930

SEQ ID NO: 114143 - RNA, 1410 nt, Artificial Sequence; identical to SEQ ID NO: 109417
  derived and/or modified sequence opt2 from neuraminidase__InfluenzaA__AFM72941

SEQ ID NO: 114144 - RNA, 1410 nt, Artificial Sequence; identical to SEQ ID NO: 109417
  derived and/or modified sequence opt2 from neuraminidase__InfluenzaA__AFM72952

SEQ ID NO: 114145 - RNA, 1410 nt, Artificial Sequence; identical to SEQ ID NO: 109417
  derived and/or modified sequence opt2 from neuraminidase__InfluenzaA__AFM72963

SEQ ID NO: 114146 - RNA, 1410 nt, Artificial Sequence; identical to SEQ ID NO: 109417
  derived and/or modified sequence opt2 from neuraminidase__InfluenzaA__AFM72974

SEQ ID NO: 114147 - RNA, 1410 nt, Artificial Sequence; identical to SEQ ID NO: 111030
  derived and/or modified sequence opt2 from neuraminidase__InfluenzaA__AFM72985

SEQ ID NO: 114148 - RNA, 1410 nt, Artificial Sequence; identical to SEQ ID NO: 111030
  derived and/or modified sequence opt2 from neuraminidase__InfluenzaA__AFM72996

SEQ ID NO: 114149 - RNA, 1410 nt, Artificial Sequence; identical to SEQ ID NO: 111030
  derived and/or modified sequence opt2 from neuraminidase__InfluenzaA__AFM73007

SEQ ID NO: 114150 - RNA, 1410 nt, Artificial Sequence
  derived and/or modified sequence opt2 from neuraminidase__InfluenzaA__AFM73018
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcaucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114151 - RNA, 1410 nt, Artificial Sequence; identical to SEQ ID NO: 114150
  derived and/or modified sequence opt2 from neuraminidase__InfluenzaA__AFM73028

SEQ ID NO: 114152 - RNA, 1410 nt, Artificial Sequence; identical to SEQ ID NO: 114150
  derived and/or modified sequence opt2 from neuraminidase__InfluenzaA__AFM73038

SEQ ID NO: 114153 - RNA, 1410 nt, Artificial Sequence; identical to SEQ ID NO: 109985
  derived and/or modified sequence opt2 from neuraminidase__InfluenzaA__AFM73048

SEQ ID NO: 114154 - RNA, 1410 nt, Artificial Sequence
  derived and/or modified sequence opt2 from neuraminidase__InfluenzaA__AFM73058
augaaccccaaccagaagaucaucaccaucggcuccuucugcaugaccaucggccucgccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaagaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114155 - RNA, 1410 nt, Artificial Sequence; identical to SEQ ID NO: 109985
  derived and/or modified sequence opt2 from neuraminidase__InfluenzaA__AFM73068

SEQ ID NO: 114156 - RNA, 1413 nt, Artificial Sequence; identical to SEQ ID NO: 106463
  derived and/or modified sequence opt2 from neuraminidase__InfluenzaA__AFM73480

SEQ ID NO: 114157 - RNA, 1350 nt, Artificial Sequence
  derived and/or modified sequence opt2 from neuraminidase__InfluenzaA__AFM78569
augaaccccaaccagaagaucaucaccaucggcuccaucugcauggucaucggcaucgucucccucaugcuccagaucggcaacaugaucuccaucugggucauccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacgacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 114158 - RNA, 1410 nt, Artificial Sequence
  derived and/or modified sequence opt2 from neuraminidase__InfluenzaA__AFM85180
augaaccccaaccagaagaucaucaccaucggcuccgucucccucaccaucgccaccaucugcuuccucacccagaucgccauccucgucaccaccgucacccuccacuucaagcaguacgagugcaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 114159 - RNA, 1410 nt, Artificial Sequence; identical to SEQ ID NO: 105615
  derived and/or modified sequence opt2 from neuraminidase__InfluenzaA__AFN11830

SEQ ID NO: 114160 - RNA, 1410 nt, Artificial Sequence
  derived and/or modified sequence opt2 from neuraminidase__InfluenzaA__AFN11831
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaacaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 114161 - RNA, 1410 nt, Artificial Sequence; identical to SEQ ID NO: 106088
  derived and/or modified sequence opt2 from neuraminidase__InfluenzaA__AFN11833

SEQ ID NO: 114162 - RNA, 1410 nt, Artificial Sequence; identical to SEQ ID NO: 108023
  derived and/or modified sequence opt2 from neuraminidase__InfluenzaA__AFN11835

SEQ ID NO: 114163 - RNA, 1410 nt, Artificial Sequence
  derived and/or modified sequence opt2 from neuraminidase__InfluenzaA__AFN11836
augaaccccaaccagaagaucaucaccaucggcuccgucucccucaccaucgccaccaugugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucauccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 114164 - RNA, 1410 nt, Artificial Sequence
  derived and/or modified sequence opt2 from neuraminidase__InfluenzaA__AFN11839
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugccagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacaugaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 114165 - RNA, 1410 nt, Artificial Sequence
  derived and/or modified sequence opt2 from neuraminidase__InfluenzaA__AFN11840
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucguccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 114166 - RNA, 1410 nt, Artificial Sequence; identical to SEQ ID NO: 107441
  derived and/or modified sequence opt2 from neuraminidase__InfluenzaA__AFN11841

SEQ ID NO: 114167 - RNA, 1410 nt, Artificial Sequence; identical to SEQ ID NO: 113529
  derived and/or modified sequence opt2 from neuraminidase__InfluenzaA__AFN11842

SEQ ID NO: 114168 - RNA, 1410 nt, Artificial Sequence
  derived and/or modified sequence opt2 from neuraminidase__InfluenzaA__AFN11844
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucggccucaugcccauguga

SEQ ID NO: 114169 - RNA, 1410 nt, Artificial Sequence; identical to SEQ ID NO: 114088
  derived and/or modified sequence opt2 from neuraminidase__InfluenzaA__AFN11845

SEQ ID NO: 114170 - RNA, 1410 nt, Artificial Sequence; identical to SEQ ID NO: 113616
  derived and/or modified sequence opt2 from neuraminidase__InfluenzaA__AFN11847

SEQ ID NO: 114171 - RNA, 1410 nt, Artificial Sequence
  derived and/or modified sequence opt2 from neuraminidase__InfluenzaA__AFN11848
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucggccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 114172 - RNA, 1410 nt, Artificial Sequence
  derived and/or modified sequence opt2 from neuraminidase__InfluenzaA__AFN11850
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114173 - RNA, 1410 nt, Artificial Sequence
  derived and/or modified sequence opt2 from neuraminidase__InfluenzaA__AFN11851
augaaccccaaccagaagaucaucaccaucggcuccgucucccucaccaucgccaccaucugccuccucaugcagaucgccauccucgucaccaccgucacccuccacuucaagcaguacgagugcaacuccccccccaacaaccaggucaugcucugcgagcccaccaucaucgagcgcaacaucaccaagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 114174 - RNA, 1410 nt, Artificial Sequence; identical to SEQ ID NO: 105839
  derived and/or modified sequence opt2 from neuraminidase__InfluenzaA__AFN11853

SEQ ID NO: 114175 - RNA, 1410 nt, Artificial Sequence
  derived and/or modified sequence opt2 from neuraminidase__InfluenzaA__AFN11855
augaaccccaaccagaagaucaucaccaucggcuccgucucccucaccaucuccaccaucugcuucuucaugcagaccgccauccucaucaccaucgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccauccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114176 - RNA, 1410 nt, Artificial Sequence; identical to SEQ ID NO: 107441
  derived and/or modified sequence opt2 from neuraminidase__InfluenzaA__AFN11857

SEQ ID NO: 114177 - RNA, 1410 nt, Artificial Sequence; identical to SEQ ID NO: 108250
  derived and/or modified sequence opt2 from neuraminidase__InfluenzaA__AFN17373

SEQ ID NO: 114178 - RNA, 1410 nt, Artificial Sequence; identical to SEQ ID NO: 113883
  derived and/or modified sequence opt2 from neuraminidase__InfluenzaA__AFN17383

SEQ ID NO: 114179 - RNA, 1410 nt, Artificial Sequence; identical to SEQ ID NO: 108250
  derived and/or modified sequence opt2 from neuraminidase__InfluenzaA__AFN17393

SEQ ID NO: 114180 - RNA, 1410 nt, Artificial Sequence; identical to SEQ ID NO: 108250
  derived and/or modified sequence opt2 from neuraminidase__InfluenzaA__AFN17403

SEQ ID NO: 114181 - RNA, 1410 nt, Artificial Sequence; identical to SEQ ID NO: 108250
  derived and/or modified sequence opt2 from neuraminidase__InfluenzaA__AFN17413

SEQ ID NO: 114182 - RNA, 1410 nt, Artificial Sequence; identical to SEQ ID NO: 108250
  derived and/or modified sequence opt2 from neuraminidase__InfluenzaA__AFN17423

SEQ ID NO: 114183 - RNA, 1410 nt, Artificial Sequence; identical to SEQ ID NO: 108250
  derived and/or modified sequence opt2 from neuraminidase__InfluenzaA__AFN17433

SEQ ID NO: 114184 - RNA, 1410 nt, Artificial Sequence; identical to SEQ ID NO: 108250
  derived and/or modified sequence opt2 from neuraminidase__InfluenzaA__AFN17443

SEQ ID NO: 114185 - RNA, 1410 nt, Artificial Sequence; identical to SEQ ID NO: 108250
  derived and/or modified sequence opt2 from neuraminidase__InfluenzaA__AFN17453

SEQ ID NO: 114186 - RNA, 1410 nt, Artificial Sequence; identical to SEQ ID NO: 108250
  derived and/or modified sequence opt2 from neuraminidase__InfluenzaA__AFN17459

SEQ ID NO: 114187 - RNA, 1410 nt, Artificial Sequence; identical to SEQ ID NO: 108250
  derived and/or modified sequence opt2 from neuraminidase__InfluenzaA__AFN17469

SEQ ID NO: 114188 - RNA, 1410 nt, Artificial Sequence; identical to SEQ ID NO: 108250
  derived and/or modified sequence opt2 from neuraminidase__InfluenzaA__AFN17479

SEQ ID NO: 114189 - RNA, 1410 nt, Artificial Sequence; identical to SEQ ID NO: 108250
  derived and/or modified sequence opt2 from neuraminidase__InfluenzaA__AFN17489

SEQ ID NO: 114190 - RNA, 1410 nt, Artificial Sequence; identical to SEQ ID NO: 108250
  derived and/or modified sequence opt2 from neuraminidase__InfluenzaA__AFN17499

SEQ ID NO: 114191 - RNA, 1410 nt, Artificial Sequence; identical to SEQ ID NO: 108250
  derived and/or modified sequence opt2 from neuraminidase__InfluenzaA__AFN17509

SEQ ID NO: 114192 - RNA, 1410 nt, Artificial Sequence; identical to SEQ ID NO: 108250
  derived and/or modified sequence opt2 from neuraminidase__InfluenzaA__AFN17519

SEQ ID NO: 114193 - RNA, 1410 nt, Artificial Sequence; identical to SEQ ID NO: 108250
  derived and/or modified sequence opt2 from neuraminidase__InfluenzaA__AFN17529

SEQ ID NO: 114194 - RNA, 1410 nt, Artificial Sequence; identical to SEQ ID NO: 108250
  derived and/or modified sequence opt2 from neuraminidase__InfluenzaA__AFN17539

SEQ ID NO: 114195 - RNA, 1410 nt, Artificial Sequence; identical to SEQ ID NO: 108250
  derived and/or modified sequence opt2 from neuraminidase__InfluenzaA__AFN17549

SEQ ID NO: 114196 - RNA, 1410 nt, Artificial Sequence; identical to SEQ ID NO: 108250
  derived and/or modified sequence opt2 from neuraminidase__InfluenzaA__AFN17559

SEQ ID NO: 114197 - RNA, 1410 nt, Artificial Sequence; identical to SEQ ID NO: 108250
  derived and/or modified sequence opt2 from neuraminidase__InfluenzaA__AFN17569

SEQ ID NO: 114198 - RNA, 1410 nt, Artificial Sequence; identical to SEQ ID NO: 108250
  derived and/or modified sequence opt2 from neuraminidase__InfluenzaA__AFN17575

SEQ ID NO: 114199 - RNA, 1410 nt, Artificial Sequence; identical to SEQ ID NO: 108250
  derived and/or modified sequence opt2 from neuraminidase__InfluenzaA__AFN17581

SEQ ID NO: 114200 - RNA, 1410 nt, Artificial Sequence; identical to SEQ ID NO: 108250
  derived and/or modified sequence opt2 from neuraminidase__InfluenzaA__AFN17587

SEQ ID NO: 114201 - RNA, 1410 nt, Artificial Sequence; identical to SEQ ID NO: 108250
  derived and/or modified sequence opt2 from neuraminidase__InfluenzaA__AFN17597

SEQ ID NO: 114202 - RNA, 1410 nt, Artificial Sequence; identical to SEQ ID NO: 113883
  derived and/or modified sequence opt2 from neuraminidase__InfluenzaA__AFN17607

SEQ ID NO: 114203 - RNA, 1410 nt, Artificial Sequence; identical to SEQ ID NO: 108250
  derived and/or modified sequence opt2 from neuraminidase__InfluenzaA__AFN17617

SEQ ID NO: 114204 - RNA, 1410 nt, Artificial Sequence; identical to SEQ ID NO: 108250
  derived and/or modified sequence opt2 from neuraminidase__InfluenzaA__AFN17627

SEQ ID NO: 114205 - RNA, 1410 nt, Artificial Sequence; identical to SEQ ID NO: 108250
  derived and/or modified sequence opt2 from neuraminidase__InfluenzaA__AFN17637

SEQ ID NO: 114206 - RNA, 1410 nt, Artificial Sequence; identical to SEQ ID NO: 108250
  derived and/or modified sequence opt2 from neuraminidase__InfluenzaA__AFN17647

SEQ ID NO: 114207 - RNA, 1410 nt, Artificial Sequence; identical to SEQ ID NO: 108250
  derived and/or modified sequence opt2 from neuraminidase__InfluenzaA__AFN17657

SEQ ID NO: 114208 - RNA, 1410 nt, Artificial Sequence; identical to SEQ ID NO: 108250
  derived and/or modified sequence opt2 from neuraminidase__InfluenzaA__AFN17667

SEQ ID NO: 114209 - RNA, 1410 nt, Artificial Sequence; identical to SEQ ID NO: 108250
  derived and/or modified sequence opt2 from neuraminidase__InfluenzaA__AFN17677

SEQ ID NO: 114210 - RNA, 1410 nt, Artificial Sequence; identical to SEQ ID NO: 113883
  derived and/or modified sequence opt2 from neuraminidase__InfluenzaA__AFN17687

SEQ ID NO: 114211 - RNA, 1410 nt, Artificial Sequence; identical to SEQ ID NO: 108250
  derived and/or modified sequence opt2 from neuraminidase__InfluenzaA__AFN17697

SEQ ID NO: 114212 - RNA, 1410 nt, Artificial Sequence; identical to SEQ ID NO: 113883
  derived and/or modified sequence opt2 from neuraminidase__InfluenzaA__AFN17707

SEQ ID NO: 114213 - RNA, 1410 nt, Artificial Sequence; identical to SEQ ID NO: 108250
  derived and/or modified sequence opt2 from neuraminidase__InfluenzaA__AFN17717

SEQ ID NO: 114214 - RNA, 1410 nt, Artificial Sequence; identical to SEQ ID NO: 113883
  derived and/or modified sequence opt2 from neuraminidase__InfluenzaA__AFN17727

SEQ ID NO: 114215 - RNA, 1410 nt, Artificial Sequence; identical to SEQ ID NO: 108250
  derived and/or modified sequence opt2 from neuraminidase__InfluenzaA__AFN17737

SEQ ID NO: 114216 - RNA, 1410 nt, Artificial Sequence; identical to SEQ ID NO: 108250
  derived and/or modified sequence opt2 from neuraminidase__InfluenzaA__AFN17743

SEQ ID NO: 114217 - RNA, 1410 nt, Artificial Sequence; identical to SEQ ID NO: 113883
  derived and/or modified sequence opt2 from neuraminidase__InfluenzaA__AFN17749

SEQ ID NO: 114218 - RNA, 1410 nt, Artificial Sequence; identical to SEQ ID NO: 108250
  derived and/or modified sequence opt2 from neuraminidase__InfluenzaA__AFN17759

SEQ ID NO: 114219 - RNA, 1410 nt, Artificial Sequence; identical to SEQ ID NO: 108250
  derived and/or modified sequence opt2 from neuraminidase__InfluenzaA__AFN17769

SEQ ID NO: 114220 - RNA, 1410 nt, Artificial Sequence; identical to SEQ ID NO: 108250
  derived and/or modified sequence opt2 from neuraminidase__InfluenzaA__AFN17775

SEQ ID NO: 114221 - RNA, 1410 nt, Artificial Sequence
  derived and/or modified sequence opt2 from neuraminidase__InfluenzaA__AFN17785
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114222 - RNA, 1410 nt, Artificial Sequence
  derived and/or modified sequence opt2 from neuraminidase__InfluenzaA__AFN17795
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucggcggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114223 - RNA, 1410 nt, Artificial Sequence; identical to SEQ ID NO: 108250
  derived and/or modified sequence opt2 from neuraminidase__InfluenzaA__AFN17805

SEQ ID NO: 114224 - RNA, 1410 nt, Artificial Sequence
  derived and/or modified sequence opt2 from neuraminidase__InfluenzaA__AFN17815
augaaccccaaccagaagaucaucaccaucggcuccgucuccaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114225 - RNA, 1410 nt, Artificial Sequence; identical to SEQ ID NO: 108250
  derived and/or modified sequence opt2 from neuraminidase__InfluenzaA__AFN17825

SEQ ID NO: 114226 - RNA, 1410 nt, Artificial Sequence; identical to SEQ ID NO: 113883
  derived and/or modified sequence opt2 from neuraminidase__InfluenzaA__AFN17835

SEQ ID NO: 114227 - RNA, 1410 nt, Artificial Sequence; identical to SEQ ID NO: 108250
  derived and/or modified sequence opt2 from neuraminidase__InfluenzaA__AFN17845

SEQ ID NO: 114228 - RNA, 1410 nt, Artificial Sequence; identical to SEQ ID NO: 108250
  derived and/or modified sequence opt2 from neuraminidase__InfluenzaA__AFN17855

SEQ ID NO: 114229 - RNA, 1410 nt, Artificial Sequence; identical to SEQ ID NO: 110064
  derived and/or modified sequence opt2 from neuraminidase__InfluenzaA__AFN17865

SEQ ID NO: 114230 - RNA, 1410 nt, Artificial Sequence; identical to SEQ ID NO: 113883
  derived and/or modified sequence opt2 from neuraminidase__InfluenzaA__AFN17875

SEQ ID NO: 114231 - RNA, 1410 nt, Artificial Sequence; identical to SEQ ID NO: 113883
  derived and/or modified sequence opt2 from neuraminidase__InfluenzaA__AFN17885

SEQ ID NO: 114232 - RNA, 1410 nt, Artificial Sequence; identical to SEQ ID NO: 108250
  derived and/or modified sequence opt2 from neuraminidase__InfluenzaA__AFN17895

SEQ ID NO: 114233 - RNA, 1410 nt, Artificial Sequence; identical to SEQ ID NO: 113883
  derived and/or modified sequence opt2 from neuraminidase__InfluenzaA__AFN17905

SEQ ID NO: 114234 - RNA, 1410 nt, Artificial Sequence; identical to SEQ ID NO: 108250
  derived and/or modified sequence opt2 from neuraminidase__InfluenzaA__AFN17911

SEQ ID NO: 114235 - RNA, 1410 nt, Artificial Sequence; identical to SEQ ID NO: 113883
  derived and/or modified sequence opt2 from neuraminidase__InfluenzaA__AFN17921

SEQ ID NO: 114236 - RNA, 1410 nt, Artificial Sequence
  derived and/or modified sequence opt2 from neuraminidase__InfluenzaA__AFN17931
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcucccgcggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114237 - RNA, 1410 nt, Artificial Sequence; identical to SEQ ID NO: 108250
  derived and/or modified sequence opt2 from neuraminidase__InfluenzaA__AFN17941

SEQ ID NO: 114238 - RNA, 1410 nt, Artificial Sequence; identical to SEQ ID NO: 108250
  derived and/or modified sequence opt2 from neuraminidase__InfluenzaA__AFN17951

SEQ ID NO: 114239 - RNA, 1410 nt, Artificial Sequence
  derived and/or modified sequence opt2 from neuraminidase__InfluenzaA__AFN17961
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaacuccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114240 - RNA, 1410 nt, Artificial Sequence; identical to SEQ ID NO: 108250
  derived and/or modified sequence opt2 from neuraminidase__InfluenzaA__AFN17971

SEQ ID NO: 114241 - RNA, 1410 nt, Artificial Sequence; identical to SEQ ID NO: 108250
  derived and/or modified sequence opt2 from neuraminidase__InfluenzaA__AFN17981

SEQ ID NO: 114242 - RNA, 1410 nt, Artificial Sequence; identical to SEQ ID NO: 108250
  derived and/or modified sequence opt2 from neuraminidase__InfluenzaA__AFN17991

SEQ ID NO: 114243 - RNA, 1410 nt, Artificial Sequence
  derived and/or modified sequence opt2 from neuraminidase__InfluenzaA__AFN18001
augaaccccaaccagaagaucaucaccaucuccuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114244 - RNA, 1410 nt, Artificial Sequence; identical to SEQ ID NO: 108250
  derived and/or modified sequence opt2 from neuraminidase__InfluenzaA__AFN18011

SEQ ID NO: 114245 - RNA, 1410 nt, Artificial Sequence; identical to SEQ ID NO: 108250
  derived and/or modified sequence opt2 from neuraminidase__InfluenzaA__AFN18021

SEQ ID NO: 114246 - RNA, 1410 nt, Artificial Sequence
  derived and/or modified sequence opt2 from neuraminidase__InfluenzaA__AFN18031
augaaccccaaccagaagaucaucaccaucggcuccaucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114247 - RNA, 1410 nt, Artificial Sequence; identical to SEQ ID NO: 108250
  derived and/or modified sequence opt2 from neuraminidase__InfluenzaA__AFN18041

SEQ ID NO: 114248 - RNA, 1410 nt, Artificial Sequence; identical to SEQ ID NO: 113883
  derived and/or modified sequence opt2 from neuraminidase__InfluenzaA__AFN18051

SEQ ID NO: 114249 - RNA, 1410 nt, Artificial Sequence; identical to SEQ ID NO: 113883
  derived and/or modified sequence opt2 from neuraminidase__InfluenzaA__AFN18061

SEQ ID NO: 114250 - RNA, 1410 nt, Artificial Sequence; identical to SEQ ID NO: 108250
  derived and/or modified sequence opt2 from neuraminidase__InfluenzaA__AFN18070

SEQ ID NO: 114251 - RNA, 1410 nt, Artificial Sequence; identical to SEQ ID NO: 108250
  derived and/or modified sequence opt2 from neuraminidase__InfluenzaA__AFN18080

SEQ ID NO: 114252 - RNA, 1410 nt, Artificial Sequence; identical to SEQ ID NO: 108250
  derived and/or modified sequence opt2 from neuraminidase__InfluenzaA__AFN18090

SEQ ID NO: 114253 - RNA, 1410 nt, Artificial Sequence; identical to SEQ ID NO: 108250
  derived and/or modified sequence opt2 from neuraminidase__InfluenzaA__AFN18100

SEQ ID NO: 114254 - RNA, 1410 nt, Artificial Sequence; identical to SEQ ID NO: 108250
  derived and/or modified sequence opt2 from neuraminidase__InfluenzaA__AFN18106

SEQ ID NO: 114255 - RNA, 1410 nt, Artificial Sequence
  derived and/or modified sequence opt2 from neuraminidase__InfluenzaA__AFN18108
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccguccucuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114256 - RNA, 1410 nt, Artificial Sequence
  derived and/or modified sequence opt2 from neuraminidase__InfluenzaA__AFN18118
augaaccccaaccagaagaucaucaccaucggcuccgucugcaugaccaucggcauggccaaccucauccuccagaucggcaacaugaucuccaucuggaucucccacuccauccagcucggcaaccagaaccagaucgagaccugcaaccaguccgucaucaccuacgagaacaacaccugggucaaccagaccuacgucaagaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114257 - RNA, 1410 nt, Artificial Sequence; identical to SEQ ID NO: 108250
  derived and/or modified sequence opt2 from neuraminidase__InfluenzaA__AFN18120

SEQ ID NO: 114258 - RNA, 1410 nt, Artificial Sequence; identical to SEQ ID NO: 108250
  derived and/or modified sequence opt2 from neuraminidase__InfluenzaA__AFN18122

SEQ ID NO: 114259 - RNA, 1410 nt, Artificial Sequence; identical to SEQ ID NO: 113883
  derived and/or modified sequence opt2 from neuraminidase__InfluenzaA__AFN18128

SEQ ID NO: 114260 - RNA, 1410 nt, Artificial Sequence; identical to SEQ ID NO: 113883
  derived and/or modified sequence opt2 from neuraminidase__InfluenzaA__AFN18134

SEQ ID NO: 114261 - RNA, 1410 nt, Artificial Sequence; identical to SEQ ID NO: 108250
  derived and/or modified sequence opt2 from neuraminidase__InfluenzaA__AFN18136

SEQ ID NO: 114262 - RNA, 1410 nt, Artificial Sequence; identical to SEQ ID NO: 108250
  derived and/or modified sequence opt2 from neuraminidase__InfluenzaA__AFN18138

SEQ ID NO: 114263 - RNA, 1410 nt, Artificial Sequence
  derived and/or modified sequence opt2 from neuraminidase__InfluenzaA__AFN18140
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcaucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114264 - RNA, 1410 nt, Artificial Sequence; identical to SEQ ID NO: 108250
  derived and/or modified sequence opt2 from neuraminidase__InfluenzaA__AFN18144

SEQ ID NO: 114265 - RNA, 1410 nt, Artificial Sequence; identical to SEQ ID NO: 108250
  derived and/or modified sequence opt2 from neuraminidase__InfluenzaA__AFN18150

SEQ ID NO: 114266 - RNA, 1410 nt, Artificial Sequence; identical to SEQ ID NO: 108250
  derived and/or modified sequence opt2 from neuraminidase__InfluenzaA__AFN18156

SEQ ID NO: 114267 - RNA, 1410 nt, Artificial Sequence; identical to SEQ ID NO: 108250
  derived and/or modified sequence opt2 from neuraminidase__InfluenzaA__AFN18158

SEQ ID NO: 114268 - RNA, 1410 nt, Artificial Sequence; identical to SEQ ID NO: 110064
  derived and/or modified sequence opt2 from neuraminidase__InfluenzaA__AFN18160

SEQ ID NO: 114269 - RNA, 1410 nt, Artificial Sequence
  derived and/or modified sequence opt2 from neuraminidase__InfluenzaA__AFN18166
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaagaccugggucaaccagaccuacgucaacaucuccaacgccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacuccaaguucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114270 - RNA, 1410 nt, Artificial Sequence; identical to SEQ ID NO: 108250
  derived and/or modified sequence opt2 from neuraminidase__InfluenzaA__AFN18172

SEQ ID NO: 114271 - RNA, 1410 nt, Artificial Sequence; identical to SEQ ID NO: 109268
  derived and/or modified sequence opt2 from neuraminidase__InfluenzaA__AFN18178

SEQ ID NO: 114272 - RNA, 1410 nt, Artificial Sequence
  derived and/or modified sequence opt2 from neuraminidase__InfluenzaA__AFN18184
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccauggucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114273 - RNA, 1410 nt, Artificial Sequence; identical to SEQ ID NO: 111242
  derived and/or modified sequence opt2 from neuraminidase__InfluenzaA__AFN18190

SEQ ID NO: 114274 - RNA, 1410 nt, Artificial Sequence; identical to SEQ ID NO: 112263
  derived and/or modified sequence opt2 from neuraminidase__InfluenzaA__AFN18196

SEQ ID NO: 114275 - RNA, 1410 nt, Artificial Sequence
  derived and/or modified sequence opt2 from neuraminidase__InfluenzaA__AFN18202
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccgcuccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114276 - RNA, 1410 nt, Artificial Sequence; identical to SEQ ID NO: 108250
  derived and/or modified sequence opt2 from neuraminidase__InfluenzaA__AFN18208

SEQ ID NO: 114277 - RNA, 1410 nt, Artificial Sequence
  derived and/or modified sequence opt2 from neuraminidase__InfluenzaA__AFN18210
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcgccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccucaaggagaacaccaucuggaccuccggcuccuccaucuccuucugcggcgucaacuccgacaccgucggcugguccuggcccgacggcgccgagcuccccuucaccaucgacaaguga

SEQ ID NO: 114278 - RNA, 1410 nt, Artificial Sequence; identical to SEQ ID NO: 108833
  derived and/or modified sequence opt2 from neuraminidase__InfluenzaA__AFN18216

SEQ ID NO: 114279 - RNA, 1410 nt, Artificial Sequence; identical to SEQ ID NO: 110579
  derived and/or modified sequence opt2 from neuraminidase__InfluenzaA__AFN18226

SEQ ID NO: 114280 - RNA, 1410 nt, Artificial Sequence; identical to SEQ ID NO: 108250
  derived and/or modified sequence opt2 from neuraminidase__InfluenzaA__AFN18232

SEQ ID NO: 114281 - RNA, 1410 nt, Artificial Sequence; identical to SEQ ID NO: 108250
  derived and/or modified sequence opt2 from neuraminidase__InfluenzaA__AFN18234

SEQ ID NO: 114282 - RNA, 1410 nt, Artificial Sequence; identical to SEQ ID NO: 108250
  derived and/or modified sequence opt2 from neuraminidase__InfluenzaA__AFN18244

SEQ ID NO: 114283 - RNA, 1410 nt, Artificial Sequence; identical to SEQ ID NO: 108250
  derived and/or modified sequence opt2 from neuraminidase__InfluenzaA__AFN18246

SEQ ID NO: 114284 - RNA, 1410 nt, Artificial Sequence; identical to SEQ ID NO: 110579
  derived and/or modified sequence opt2 from neuraminidase__InfluenzaA__AFN18256

SEQ ID NO: 114285 - RNA, 1410 nt, Artificial Sequence; identical to SEQ ID NO: 108250
  derived and/or modified sequence opt2 from neuraminidase__InfluenzaA__AFN18262

SEQ ID NO: 114286 - RNA, 1410 nt, Artificial Sequence; identical to SEQ ID NO: 108250
  derived and/or modified sequence opt2 from neuraminidase__InfluenzaA__AFN18268

SEQ ID NO: 114287 - RNA, 1410 nt, Artificial Sequence; identical to SEQ ID NO: 108250
  derived and/or modified sequence opt2 from neuraminidase__InfluenzaA__AFN18270

SEQ ID NO: 114288 - RNA, 1410 nt, Artificial Sequence; identical to SEQ ID NO: 111239
  derived and/or modified sequence opt2 from neuraminidase__InfluenzaA__AFN18272

SEQ ID NO: 114289 - RNA, 1410 nt, Artificial Sequence; identical to SEQ ID NO: 108250
  derived and/or modified sequence opt2 from neuraminidase__InfluenzaA__AFN18274

SEQ ID NO: 114290 - RNA, 1410 nt, Artificial Sequence; identical to SEQ ID NO: 108250
  derived and/or modified sequence opt2 from neuraminidase__InfluenzaA__AFN18282

SEQ ID NO: 114291 - RNA, 1410 nt, Artificial Sequence; identical to SEQ ID NO: 108250
  derived and/or modified sequence opt2 from neuraminidase__InfluenzaA__AFN18304

SEQ ID NO: 114292 - RNA, 1410 nt, Artificial Sequence
  derived and/or modified sequence opt2 from neuraminidase__InfluenzaA__AFN18306
augaaccccaaccagaagaucaucaccaucggcuccgucugcaugaccaucggcaucgccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114293 - RNA, 1410 nt, Artificial Sequence
  derived and/or modified sequence opt2 from neuraminidase__InfluenzaA__AFN18308
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaagggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114294 - RNA, 1410 nt, Artificial Sequence
  derived and/or modified sequence opt2 from neuraminidase__InfluenzaA__AFN18314
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaagaccaucuggaccuccggcuccuccaucuccuucugcggcgucaacuccgacaccgucggcugguccuggcccgacggcgccgagcuccccuucaccaucgacaaguga

SEQ ID NO: 114295 - RNA, 1410 nt, Artificial Sequence; identical to SEQ ID NO: 108250
  derived and/or modified sequence opt2 from neuraminidase__InfluenzaA__AFN18320

SEQ ID NO: 114296 - RNA, 1410 nt, Artificial Sequence
  derived and/or modified sequence opt2 from neuraminidase__InfluenzaA__AFN18326
augaaccccaaccagaagaucaucaccaucggcuccgucugcaugaccaucggcauggccaaccuccuccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114297 - RNA, 1410 nt, Artificial Sequence; identical to SEQ ID NO: 108250
  derived and/or modified sequence opt2 from neuraminidase__InfluenzaA__AFN18336

SEQ ID NO: 114298 - RNA, 1410 nt, Artificial Sequence; identical to SEQ ID NO: 108250
  derived and/or modified sequence opt2 from neuraminidase__InfluenzaA__AFN18346

SEQ ID NO: 114299 - RNA, 1410 nt, Artificial Sequence; identical to SEQ ID NO: 113883
  derived and/or modified sequence opt2 from neuraminidase__InfluenzaA__AFN18356

SEQ ID NO: 114300 - RNA, 1410 nt, Artificial Sequence
  derived and/or modified sequence opt2 from neuraminidase__InfluenzaA__AFN18366
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccgagcaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgaggucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114301 - RNA, 1410 nt, Artificial Sequence; identical to SEQ ID NO: 113883
  derived and/or modified sequence opt2 from neuraminidase__InfluenzaA__AFN18376

SEQ ID NO: 114302 - RNA, 1410 nt, Artificial Sequence; identical to SEQ ID NO: 108250
  derived and/or modified sequence opt2 from neuraminidase__InfluenzaA__AFN18382

SEQ ID NO: 114303 - RNA, 1410 nt, Artificial Sequence; identical to SEQ ID NO: 108250
  derived and/or modified sequence opt2 from neuraminidase__InfluenzaA__AFN18392

SEQ ID NO: 114304 - RNA, 1410 nt, Artificial Sequence; identical to SEQ ID NO: 108250
  derived and/or modified sequence opt2 from neuraminidase__InfluenzaA__AFN18402

SEQ ID NO: 114305 - RNA, 1410 nt, Artificial Sequence; identical to SEQ ID NO: 108250
  derived and/or modified sequence opt2 from neuraminidase__InfluenzaA__AFN18412

SEQ ID NO: 114306 - RNA, 1410 nt, Artificial Sequence; identical to SEQ ID NO: 108250
  derived and/or modified sequence opt2 from neuraminidase__InfluenzaA__AFN18422

SEQ ID NO: 114307 - RNA, 1410 nt, Artificial Sequence; identical to SEQ ID NO: 108250
  derived and/or modified sequence opt2 from neuraminidase__InfluenzaA__AFN18432

SEQ ID NO: 114308 - RNA, 1410 nt, Artificial Sequence; identical to SEQ ID NO: 108250
  derived and/or modified sequence opt2 from neuraminidase__InfluenzaA__AFN18442

SEQ ID NO: 114309 - RNA, 1410 nt, Artificial Sequence; identical to SEQ ID NO: 108250
  derived and/or modified sequence opt2 from neuraminidase__InfluenzaA__AFN18452

SEQ ID NO: 114310 - RNA, 1410 nt, Artificial Sequence; identical to SEQ ID NO: 108250
  derived and/or modified sequence opt2 from neuraminidase__InfluenzaA__AFN18462

SEQ ID NO: 114311 - RNA, 1410 nt, Artificial Sequence
  derived and/or modified sequence opt2 from neuraminidase__InfluenzaA__AFN18472
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaagggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114312 - RNA, 1410 nt, Artificial Sequence; identical to SEQ ID NO: 108250
  derived and/or modified sequence opt2 from neuraminidase__InfluenzaA__AFN18482

SEQ ID NO: 114313 - RNA, 1410 nt, Artificial Sequence; identical to SEQ ID NO: 108250
  derived and/or modified sequence opt2 from neuraminidase__InfluenzaA__AFN18492

SEQ ID NO: 114314 - RNA, 1410 nt, Artificial Sequence
  derived and/or modified sequence opt2 from neuraminidase__InfluenzaA__AFN18514
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114315 - RNA, 1410 nt, Artificial Sequence
  derived and/or modified sequence opt2 from neuraminidase__InfluenzaA__AFN18520
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcgucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114316 - RNA, 1410 nt, Artificial Sequence; identical to SEQ ID NO: 108250
  derived and/or modified sequence opt2 from neuraminidase__InfluenzaA__AFN18522

SEQ ID NO: 114317 - RNA, 1410 nt, Artificial Sequence; identical to SEQ ID NO: 108250
  derived and/or modified sequence opt2 from neuraminidase__InfluenzaA__AFN18524

SEQ ID NO: 114318 - RNA, 1410 nt, Artificial Sequence; identical to SEQ ID NO: 113883
  derived and/or modified sequence opt2 from neuraminidase__InfluenzaA__AFN18530

SEQ ID NO: 114319 - RNA, 1410 nt, Artificial Sequence; identical to SEQ ID NO: 108250
  derived and/or modified sequence opt2 from neuraminidase__InfluenzaA__AFN18532

SEQ ID NO: 114320 - RNA, 1410 nt, Artificial Sequence; identical to SEQ ID NO: 108250
  derived and/or modified sequence opt2 from neuraminidase__InfluenzaA__AFN18538

SEQ ID NO: 114321 - RNA, 1410 nt, Artificial Sequence; identical to SEQ ID NO: 108250
  derived and/or modified sequence opt2 from neuraminidase__InfluenzaA__AFN18544

SEQ ID NO: 114322 - RNA, 1410 nt, Artificial Sequence; identical to SEQ ID NO: 108250
  derived and/or modified sequence opt2 from neuraminidase__InfluenzaA__AFN18546

SEQ ID NO: 114323 - RNA, 1410 nt, Artificial Sequence; identical to SEQ ID NO: 108250
  derived and/or modified sequence opt2 from neuraminidase__InfluenzaA__AFN18552

SEQ ID NO: 114324 - RNA, 1410 nt, Artificial Sequence; identical to SEQ ID NO: 108250
  derived and/or modified sequence opt2 from neuraminidase__InfluenzaA__AFN18558

SEQ ID NO: 114325 - RNA, 1410 nt, Artificial Sequence; identical to SEQ ID NO: 108250
  derived and/or modified sequence opt2 from neuraminidase__InfluenzaA__AFN18560

SEQ ID NO: 114326 - RNA, 1410 nt, Artificial Sequence; identical to SEQ ID NO: 108250
  derived and/or modified sequence opt2 from neuraminidase__InfluenzaA__AFN18562

SEQ ID NO: 114327 - RNA, 1410 nt, Artificial Sequence; identical to SEQ ID NO: 108250
  derived and/or modified sequence opt2 from neuraminidase__InfluenzaA__AFN18564

SEQ ID NO: 114328 - RNA, 1410 nt, Artificial Sequence; identical to SEQ ID NO: 108250
  derived and/or modified sequence opt2 from neuraminidase__InfluenzaA__AFN18566

SEQ ID NO: 114329 - RNA, 1410 nt, Artificial Sequence; identical to SEQ ID NO: 108250
  derived and/or modified sequence opt2 from neuraminidase__InfluenzaA__AFN18572

SEQ ID NO: 114330 - RNA, 1410 nt, Artificial Sequence; identical to SEQ ID NO: 108250
  derived and/or modified sequence opt2 from neuraminidase__InfluenzaA__AFN18582

SEQ ID NO: 114331 - RNA, 1410 nt, Artificial Sequence; identical to SEQ ID NO: 108250
  derived and/or modified sequence opt2 from neuraminidase__InfluenzaA__AFN18592

SEQ ID NO: 114332 - RNA, 1410 nt, Artificial Sequence; identical to SEQ ID NO: 113883
  derived and/or modified sequence opt2 from neuraminidase__InfluenzaA__AFN18602

SEQ ID NO: 114333 - RNA, 1410 nt, Artificial Sequence
  derived and/or modified sequence opt2 from neuraminidase__InfluenzaA__AFN18612
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114334 - RNA, 1410 nt, Artificial Sequence; identical to SEQ ID NO: 108250
  derived and/or modified sequence opt2 from neuraminidase__InfluenzaA__AFN18618

SEQ ID NO: 114335 - RNA, 1410 nt, Artificial Sequence; identical to SEQ ID NO: 109076
  derived and/or modified sequence opt2 from neuraminidase__InfluenzaA__AFN18624

SEQ ID NO: 114336 - RNA, 1410 nt, Artificial Sequence
  derived and/or modified sequence opt2 from neuraminidase__InfluenzaA__AFN18630
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucggcugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114337 - RNA, 1410 nt, Artificial Sequence
  derived and/or modified sequence opt2 from neuraminidase__InfluenzaA__AFN18636
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgcuccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114338 - RNA, 1410 nt, Artificial Sequence; identical to SEQ ID NO: 108250
  derived and/or modified sequence opt2 from neuraminidase__InfluenzaA__AFN18646

SEQ ID NO: 114339 - RNA, 1410 nt, Artificial Sequence; identical to SEQ ID NO: 108250
  derived and/or modified sequence opt2 from neuraminidase__InfluenzaA__AFN18656

SEQ ID NO: 114340 - RNA, 1410 nt, Artificial Sequence
  derived and/or modified sequence opt2 from neuraminidase__InfluenzaA__AFN18666
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaucaucgacaaguga

SEQ ID NO: 114341 - RNA, 1410 nt, Artificial Sequence
  derived and/or modified sequence opt2 from neuraminidase__InfluenzaA__AFN18676
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114342 - RNA, 1410 nt, Artificial Sequence
  derived and/or modified sequence opt2 from neuraminidase__InfluenzaA__AFN18686
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccuccaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114343 - RNA, 1410 nt, Artificial Sequence; identical to SEQ ID NO: 108250
  derived and/or modified sequence opt2 from neuraminidase__InfluenzaA__AFN18696

SEQ ID NO: 114344 - RNA, 1410 nt, Artificial Sequence; identical to SEQ ID NO: 110837
  derived and/or modified sequence opt2 from neuraminidase__InfluenzaA__AFN18706

SEQ ID NO: 114345 - RNA, 1410 nt, Artificial Sequence; identical to SEQ ID NO: 108250
  derived and/or modified sequence opt2 from neuraminidase__InfluenzaA__AFN18716

SEQ ID NO: 114346 - RNA, 1410 nt, Artificial Sequence; identical to SEQ ID NO: 108250
  derived and/or modified sequence opt2 from neuraminidase__InfluenzaA__AFN18727

SEQ ID NO: 114347 - RNA, 1410 nt, Artificial Sequence
  derived and/or modified sequence opt2 from neuraminidase__InfluenzaA__AFN18737
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagauggucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114348 - RNA, 1410 nt, Artificial Sequence; identical to SEQ ID NO: 108250
  derived and/or modified sequence opt2 from neuraminidase__InfluenzaA__AFN18743

SEQ ID NO: 114349 - RNA, 1410 nt, Artificial Sequence; identical to SEQ ID NO: 108250
  derived and/or modified sequence opt2 from neuraminidase__InfluenzaA__AFN18749

SEQ ID NO: 114350 - RNA, 1410 nt, Artificial Sequence; identical to SEQ ID NO: 108250
  derived and/or modified sequence opt2 from neuraminidase__InfluenzaA__AFN18759

SEQ ID NO: 114351 - RNA, 1410 nt, Artificial Sequence
  derived and/or modified sequence opt2 from neuraminidase__InfluenzaA__AFN18769
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccaacgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114352 - RNA, 1410 nt, Artificial Sequence; identical to SEQ ID NO: 110152
  derived and/or modified sequence opt2 from neuraminidase__InfluenzaA__AFN18775

SEQ ID NO: 114353 - RNA, 1410 nt, Artificial Sequence; identical to SEQ ID NO: 108250
  derived and/or modified sequence opt2 from neuraminidase__InfluenzaA__AFN18777

SEQ ID NO: 114354 - RNA, 1410 nt, Artificial Sequence; identical to SEQ ID NO: 108250
  derived and/or modified sequence opt2 from neuraminidase__InfluenzaA__AFN18779

SEQ ID NO: 114355 - RNA, 1410 nt, Artificial Sequence
  derived and/or modified sequence opt2 from neuraminidase__InfluenzaA__AFN18785
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccauccgccaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114356 - RNA, 1410 nt, Artificial Sequence
  derived and/or modified sequence opt2 from neuraminidase__InfluenzaA__AFN18791
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgaguccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114357 - RNA, 1410 nt, Artificial Sequence; identical to SEQ ID NO: 108250
  derived and/or modified sequence opt2 from neuraminidase__InfluenzaA__AFN18801

SEQ ID NO: 114358 - RNA, 1410 nt, Artificial Sequence; identical to SEQ ID NO: 110669
  derived and/or modified sequence opt2 from neuraminidase__InfluenzaA__AFN18811

SEQ ID NO: 114359 - RNA, 1410 nt, Artificial Sequence; identical to SEQ ID NO: 108250
  derived and/or modified sequence opt2 from neuraminidase__InfluenzaA__AFN18817

SEQ ID NO: 114360 - RNA, 1410 nt, Artificial Sequence; identical to SEQ ID NO: 108250
  derived and/or modified sequence opt2 from neuraminidase__InfluenzaA__AFN18819

SEQ ID NO: 114361 - RNA, 1410 nt, Artificial Sequence; identical to SEQ ID NO: 111242
  derived and/or modified sequence opt2 from neuraminidase__InfluenzaA__AFN18821

SEQ ID NO: 114362 - RNA, 1410 nt, Artificial Sequence; identical to SEQ ID NO: 108250
  derived and/or modified sequence opt2 from neuraminidase__InfluenzaA__AFN18823

SEQ ID NO: 114363 - RNA, 1410 nt, Artificial Sequence; identical to SEQ ID NO: 108250
  derived and/or modified sequence opt2 from neuraminidase__InfluenzaA__AFN18825

SEQ ID NO: 114364 - RNA, 1410 nt, Artificial Sequence; identical to SEQ ID NO: 108250
  derived and/or modified sequence opt2 from neuraminidase__InfluenzaA__AFN18827

SEQ ID NO: 114365 - RNA, 1410 nt, Artificial Sequence; identical to SEQ ID NO: 108250
  derived and/or modified sequence opt2 from neuraminidase__InfluenzaA__AFN18829

SEQ ID NO: 114366 - RNA, 1410 nt, Artificial Sequence; identical to SEQ ID NO: 108250
  derived and/or modified sequence opt2 from neuraminidase__InfluenzaA__AFN18831

SEQ ID NO: 114367 - RNA, 1410 nt, Artificial Sequence; identical to SEQ ID NO: 109387
  derived and/or modified sequence opt2 from neuraminidase__InfluenzaA__AFN18833

SEQ ID NO: 114368 - RNA, 1410 nt, Artificial Sequence; identical to SEQ ID NO: 109425
  derived and/or modified sequence opt2 from neuraminidase__InfluenzaA__AFN18835

SEQ ID NO: 114369 - RNA, 1410 nt, Artificial Sequence; identical to SEQ ID NO: 108250
  derived and/or modified sequence opt2 from neuraminidase__InfluenzaA__AFN18841

SEQ ID NO: 114370 - RNA, 1410 nt, Artificial Sequence
  derived and/or modified sequence opt2 from neuraminidase__InfluenzaA__AFN18851
augaaccccaaccagaagaucaucaccaucggcuccgucugcaugaccaucggcauggccaaccucauccuccagaucggcaacaugaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114371 - RNA, 1410 nt, Artificial Sequence; identical to SEQ ID NO: 108250
  derived and/or modified sequence opt2 from neuraminidase__InfluenzaA__AFN18857

SEQ ID NO: 114372 - RNA, 1410 nt, Artificial Sequence
  derived and/or modified sequence opt2 from neuraminidase__InfluenzaA__AFN18859
augaaccccaaccagaagaucaucaccaucggcuccgucugcaugaccaucggccucgccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114373 - RNA, 1410 nt, Artificial Sequence
  derived and/or modified sequence opt2 from neuraminidase__InfluenzaA__AFN18861
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugcuccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114374 - RNA, 1410 nt, Artificial Sequence; identical to SEQ ID NO: 108250
  derived and/or modified sequence opt2 from neuraminidase__InfluenzaA__AFN18867

SEQ ID NO: 114375 - RNA, 1410 nt, Artificial Sequence; identical to SEQ ID NO: 110064
  derived and/or modified sequence opt2 from neuraminidase__InfluenzaA__AFN18877

SEQ ID NO: 114376 - RNA, 1410 nt, Artificial Sequence; identical to SEQ ID NO: 108250
  derived and/or modified sequence opt2 from neuraminidase__InfluenzaA__AFN18887

SEQ ID NO: 114377 - RNA, 1410 nt, Artificial Sequence; identical to SEQ ID NO: 109268
  derived and/or modified sequence opt2 from neuraminidase__InfluenzaA__AFN18893

SEQ ID NO: 114378 - RNA, 1410 nt, Artificial Sequence
  derived and/or modified sequence opt2 from neuraminidase__InfluenzaA__AFN18895
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucaucaagggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114379 - RNA, 1410 nt, Artificial Sequence; identical to SEQ ID NO: 110152
  derived and/or modified sequence opt2 from neuraminidase__InfluenzaA__AFN18905

SEQ ID NO: 114380 - RNA, 1410 nt, Artificial Sequence; identical to SEQ ID NO: 110064
  derived and/or modified sequence opt2 from neuraminidase__InfluenzaA__AFN18913

SEQ ID NO: 114381 - RNA, 1410 nt, Artificial Sequence
  derived and/or modified sequence opt2 from neuraminidase__InfluenzaA__AFN18919
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgagaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114382 - RNA, 1410 nt, Artificial Sequence
  derived and/or modified sequence opt2 from neuraminidase__InfluenzaA__AFN18929
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccugguccgacggcgccgagcuccccuucaccaucgacaaguga

SEQ ID NO: 114383 - RNA, 1410 nt, Artificial Sequence; identical to SEQ ID NO: 108250
  derived and/or modified sequence opt2 from neuraminidase__InfluenzaA__AFN18939

SEQ ID NO: 114384 - RNA, 1410 nt, Artificial Sequence; identical to SEQ ID NO: 108250
  derived and/or modified sequence opt2 from neuraminidase__InfluenzaA__AFN18953

SEQ ID NO: 114385 - RNA, 1410 nt, Artificial Sequence; identical to SEQ ID NO: 108250
  derived and/or modified sequence opt2 from neuraminidase__InfluenzaA__AFN18959

SEQ ID NO: 114386 - RNA, 1410 nt, Artificial Sequence; identical to SEQ ID NO: 108250
  derived and/or modified sequence opt2 from neuraminidase__InfluenzaA__AFN18965

SEQ ID NO: 114387 - RNA, 1410 nt, Artificial Sequence; identical to SEQ ID NO: 112320
  derived and/or modified sequence opt2 from neuraminidase__InfluenzaA__AFN18975

SEQ ID NO: 114388 - RNA, 1410 nt, Artificial Sequence; identical to SEQ ID NO: 108250
  derived and/or modified sequence opt2 from neuraminidase__InfluenzaA__AFN18981

SEQ ID NO: 114389 - RNA, 1410 nt, Artificial Sequence
  derived and/or modified sequence opt2 from neuraminidase__InfluenzaA__AFN18983
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgccuccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 114390 - RNA, 1410 nt, Artificial Sequence; identical to SEQ ID NO: 108250
  derived and/or modified sequence opt2 from neuraminidase__InfluenzaA__AFN18985

SEQ ID NO: 114391 - RNA, 1410 nt, Artificial Sequence
  derived and/or modified sequence opt2 from neuraminidase__InfluenzaA__AFN18987
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaucgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114392 - RNA, 1410 nt, Artificial Sequence; identical to SEQ ID NO: 108250
  derived and/or modified sequence opt2 from neuraminidase__InfluenzaA__AFN18989

SEQ ID NO: 114393 - RNA, 1410 nt, Artificial Sequence; identical to SEQ ID NO: 108250
  derived and/or modified sequence opt2 from neuraminidase__InfluenzaA__AFN18995

SEQ ID NO: 114394 - RNA, 1410 nt, Artificial Sequence; identical to SEQ ID NO: 114372
  derived and/or modified sequence opt2 from neuraminidase__InfluenzaA__AFN19001

SEQ ID NO: 114395 - RNA, 1410 nt, Artificial Sequence; identical to SEQ ID NO: 108250
  derived and/or modified sequence opt2 from neuraminidase__InfluenzaA__AFN19007

SEQ ID NO: 114396 - RNA, 1410 nt, Artificial Sequence; identical to SEQ ID NO: 108250
  derived and/or modified sequence opt2 from neuraminidase__InfluenzaA__AFN19024

SEQ ID NO: 114397 - RNA, 1410 nt, Artificial Sequence
  derived and/or modified sequence opt2 from neuraminidase__InfluenzaA__AFN19025
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaagauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114398 - RNA, 1410 nt, Artificial Sequence; identical to SEQ ID NO: 108250
  derived and/or modified sequence opt2 from neuraminidase__InfluenzaA__AFN19027

SEQ ID NO: 114399 - RNA, 1410 nt, Artificial Sequence; identical to SEQ ID NO: 108250
  derived and/or modified sequence opt2 from neuraminidase__InfluenzaA__AFN19032

SEQ ID NO: 114400 - RNA, 1410 nt, Artificial Sequence; identical to SEQ ID NO: 108250
  derived and/or modified sequence opt2 from neuraminidase__InfluenzaA__AFN19038

SEQ ID NO: 114401 - RNA, 1410 nt, Artificial Sequence; identical to SEQ ID NO: 113883
  derived and/or modified sequence opt2 from neuraminidase__InfluenzaA__AFN19049

SEQ ID NO: 114402 - RNA, 1410 nt, Artificial Sequence; identical to SEQ ID NO: 108250
  derived and/or modified sequence opt2 from neuraminidase__InfluenzaA__AFN19055

SEQ ID NO: 114403 - RNA, 1410 nt, Artificial Sequence; identical to SEQ ID NO: 108250
  derived and/or modified sequence opt2 from neuraminidase__InfluenzaA__AFN19065

SEQ ID NO: 114404 - RNA, 1410 nt, Artificial Sequence; identical to SEQ ID NO: 108250
  derived and/or modified sequence opt2 from neuraminidase__InfluenzaA__AFN19071

SEQ ID NO: 114405 - RNA, 1410 nt, Artificial Sequence; identical to SEQ ID NO: 108250
  derived and/or modified sequence opt2 from neuraminidase__InfluenzaA__AFN19077

SEQ ID NO: 114406 - RNA, 1410 nt, Artificial Sequence; identical to SEQ ID NO: 108250
  derived and/or modified sequence opt2 from neuraminidase__InfluenzaA__AFN19083

SEQ ID NO: 114407 - RNA, 1410 nt, Artificial Sequence; identical to SEQ ID NO: 108250
  derived and/or modified sequence opt2 from neuraminidase__InfluenzaA__AFN19089

SEQ ID NO: 114408 - RNA, 1410 nt, Artificial Sequence; identical to SEQ ID NO: 108250
  derived and/or modified sequence opt2 from neuraminidase__InfluenzaA__AFN19099

SEQ ID NO: 114409 - RNA, 1410 nt, Artificial Sequence; identical to SEQ ID NO: 108250
  derived and/or modified sequence opt2 from neuraminidase__InfluenzaA__AFN19105

SEQ ID NO: 114410 - RNA, 1410 nt, Artificial Sequence; identical to SEQ ID NO: 108250
  derived and/or modified sequence opt2 from neuraminidase__InfluenzaA__AFN19114

SEQ ID NO: 114411 - RNA, 1410 nt, Artificial Sequence; identical to SEQ ID NO: 108250
  derived and/or modified sequence opt2 from neuraminidase__InfluenzaA__AFN19126

SEQ ID NO: 114412 - RNA, 1410 nt, Artificial Sequence; identical to SEQ ID NO: 108250
  derived and/or modified sequence opt2 from neuraminidase__InfluenzaA__AFN19136

SEQ ID NO: 114413 - RNA, 1410 nt, Artificial Sequence; identical to SEQ ID NO: 108250
  derived and/or modified sequence opt2 from neuraminidase__InfluenzaA__AFN19146

SEQ ID NO: 114414 - RNA, 1410 nt, Artificial Sequence; identical to SEQ ID NO: 108250
  derived and/or modified sequence opt2 from neuraminidase__InfluenzaA__AFN19156

SEQ ID NO: 114415 - RNA, 1410 nt, Artificial Sequence; identical to SEQ ID NO: 108250
  derived and/or modified sequence opt2 from neuraminidase__InfluenzaA__AFN19166

SEQ ID NO: 114416 - RNA, 1410 nt, Artificial Sequence; identical to SEQ ID NO: 108250
  derived and/or modified sequence opt2 from neuraminidase__InfluenzaA__AFN19186

SEQ ID NO: 114417 - RNA, 1410 nt, Artificial Sequence; identical to SEQ ID NO: 113883
  derived and/or modified sequence opt2 from neuraminidase__InfluenzaA__AFN19196

SEQ ID NO: 114418 - RNA, 1410 nt, Artificial Sequence; identical to SEQ ID NO: 108250
  derived and/or modified sequence opt2 from neuraminidase__InfluenzaA__AFN19205

SEQ ID NO: 114419 - RNA, 1410 nt, Artificial Sequence; identical to SEQ ID NO: 108250
  derived and/or modified sequence opt2 from neuraminidase__InfluenzaA__AFN19215

SEQ ID NO: 114420 - RNA, 1410 nt, Artificial Sequence; identical to SEQ ID NO: 108250
  derived and/or modified sequence opt2 from neuraminidase__InfluenzaA__AFN19225

SEQ ID NO: 114421 - RNA, 1410 nt, Artificial Sequence; identical to SEQ ID NO: 108250
  derived and/or modified sequence opt2 from neuraminidase__InfluenzaA__AFN19235

SEQ ID NO: 114422 - RNA, 1410 nt, Artificial Sequence; identical to SEQ ID NO: 108250
  derived and/or modified sequence opt2 from neuraminidase__InfluenzaA__AFN19245

SEQ ID NO: 114423 - RNA, 1410 nt, Artificial Sequence; identical to SEQ ID NO: 108250
  derived and/or modified sequence opt2 from neuraminidase__InfluenzaA__AFN19251

SEQ ID NO: 114424 - RNA, 1410 nt, Artificial Sequence; identical to SEQ ID NO: 108250
  derived and/or modified sequence opt2 from neuraminidase__InfluenzaA__AFN19261

SEQ ID NO: 114425 - RNA, 1410 nt, Artificial Sequence; identical to SEQ ID NO: 113883
  derived and/or modified sequence opt2 from neuraminidase__InfluenzaA__AFN19271

SEQ ID NO: 114426 - RNA, 1410 nt, Artificial Sequence; identical to SEQ ID NO: 109981
  derived and/or modified sequence opt2 from neuraminidase__InfluenzaA__AFN19281

SEQ ID NO: 114427 - RNA, 1410 nt, Artificial Sequence
  derived and/or modified sequence opt2 from neuraminidase__InfluenzaA__AFN19287
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucuccgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114428 - RNA, 1410 nt, Artificial Sequence; identical to SEQ ID NO: 108250
  derived and/or modified sequence opt2 from neuraminidase__InfluenzaA__AFN19297

SEQ ID NO: 114429 - RNA, 1410 nt, Artificial Sequence; identical to SEQ ID NO: 108250
  derived and/or modified sequence opt2 from neuraminidase__InfluenzaA__AFN19307

SEQ ID NO: 114430 - RNA, 1410 nt, Artificial Sequence; identical to SEQ ID NO: 108250
  derived and/or modified sequence opt2 from neuraminidase__InfluenzaA__AFN19317

SEQ ID NO: 114431 - RNA, 1410 nt, Artificial Sequence; identical to SEQ ID NO: 113883
  derived and/or modified sequence opt2 from neuraminidase__InfluenzaA__AFN19327

SEQ ID NO: 114432 - RNA, 1410 nt, Artificial Sequence; identical to SEQ ID NO: 108250
  derived and/or modified sequence opt2 from neuraminidase__InfluenzaA__AFN19346

SEQ ID NO: 114433 - RNA, 1410 nt, Artificial Sequence
  derived and/or modified sequence opt2 from neuraminidase__InfluenzaA__AFN19352
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114434 - RNA, 1410 nt, Artificial Sequence
  derived and/or modified sequence opt2 from neuraminidase__InfluenzaA__AFN19354
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114435 - RNA, 1410 nt, Artificial Sequence; identical to SEQ ID NO: 114434
  derived and/or modified sequence opt2 from neuraminidase__InfluenzaA__AFN19356

SEQ ID NO: 114436 - RNA, 1410 nt, Artificial Sequence; identical to SEQ ID NO: 114434
  derived and/or modified sequence opt2 from neuraminidase__InfluenzaA__AFN19358

SEQ ID NO: 114437 - RNA, 1410 nt, Artificial Sequence; identical to SEQ ID NO: 114434
  derived and/or modified sequence opt2 from neuraminidase__InfluenzaA__AFN19360

SEQ ID NO: 114438 - RNA, 1410 nt, Artificial Sequence
  derived and/or modified sequence opt2 from neuraminidase__InfluenzaA__AFN19362
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaagcgcugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114439 - RNA, 1410 nt, Artificial Sequence; identical to SEQ ID NO: 114434
  derived and/or modified sequence opt2 from neuraminidase__InfluenzaA__AFN19364

SEQ ID NO: 114440 - RNA, 1410 nt, Artificial Sequence; identical to SEQ ID NO: 111030
  derived and/or modified sequence opt2 from neuraminidase__InfluenzaA__AFN19366

SEQ ID NO: 114441 - RNA, 1410 nt, Artificial Sequence; identical to SEQ ID NO: 114434
  derived and/or modified sequence opt2 from neuraminidase__InfluenzaA__AFN19370

SEQ ID NO: 114442 - RNA, 1410 nt, Artificial Sequence
  derived and/or modified sequence opt2 from neuraminidase__InfluenzaA__AFN19374
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114443 - RNA, 1410 nt, Artificial Sequence; identical to SEQ ID NO: 114434
  derived and/or modified sequence opt2 from neuraminidase__InfluenzaA__AFN19376

SEQ ID NO: 114444 - RNA, 1410 nt, Artificial Sequence; identical to SEQ ID NO: 114434
  derived and/or modified sequence opt2 from neuraminidase__InfluenzaA__AFN19378

SEQ ID NO: 114445 - RNA, 1410 nt, Artificial Sequence
  derived and/or modified sequence opt2 from neuraminidase__InfluenzaA__AFN19380
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccuccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114446 - RNA, 1410 nt, Artificial Sequence; identical to SEQ ID NO: 114442
  derived and/or modified sequence opt2 from neuraminidase__InfluenzaA__AFN19382

SEQ ID NO: 114447 - RNA, 1410 nt, Artificial Sequence; identical to SEQ ID NO: 114434
  derived and/or modified sequence opt2 from neuraminidase__InfluenzaA__AFN19384

SEQ ID NO: 114448 - RNA, 1410 nt, Artificial Sequence
  derived and/or modified sequence opt2 from neuraminidase__InfluenzaA__AFN19386
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccagaucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114449 - RNA, 1410 nt, Artificial Sequence; identical to SEQ ID NO: 114434
  derived and/or modified sequence opt2 from neuraminidase__InfluenzaA__AFN19388

SEQ ID NO: 114450 - RNA, 1410 nt, Artificial Sequence; identical to SEQ ID NO: 114434
  derived and/or modified sequence opt2 from neuraminidase__InfluenzaA__AFN19390

SEQ ID NO: 114451 - RNA, 1410 nt, Artificial Sequence
  derived and/or modified sequence opt2 from neuraminidase__InfluenzaA__AFN19392
augaaccccaaccagaagaucaucaccaucggcuccgucucccucaccaucuccaccaucugcuucuucaugcagaucgccguccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114452 - RNA, 1410 nt, Artificial Sequence; identical to SEQ ID NO: 113299
  derived and/or modified sequence opt2 from neuraminidase__InfluenzaA__AFN19394

SEQ ID NO: 114453 - RNA, 1410 nt, Artificial Sequence
  derived and/or modified sequence opt2 from neuraminidase__InfluenzaA__AFN19396
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114454 - RNA, 1410 nt, Artificial Sequence
  derived and/or modified sequence opt2 from neuraminidase__InfluenzaA__AFN19398
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114455 - RNA, 1410 nt, Artificial Sequence
  derived and/or modified sequence opt2 from neuraminidase__InfluenzaA__AFN19400
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccuccgaguaccgcaacugguccaagccccagugcgacaucaccggcuucgcccccuucuccaaggacaacuccauccgccucuccgacggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114456 - RNA, 1410 nt, Artificial Sequence; identical to SEQ ID NO: 114434
  derived and/or modified sequence opt2 from neuraminidase__InfluenzaA__AFN19402

SEQ ID NO: 114457 - RNA, 1410 nt, Artificial Sequence; identical to SEQ ID NO: 114434
  derived and/or modified sequence opt2 from neuraminidase__InfluenzaA__AFN19404

SEQ ID NO: 114458 - RNA, 1410 nt, Artificial Sequence; identical to SEQ ID NO: 114434
  derived and/or modified sequence opt2 from neuraminidase__InfluenzaA__AFN19406

SEQ ID NO: 114459 - RNA, 1410 nt, Artificial Sequence; identical to SEQ ID NO: 114434
  derived and/or modified sequence opt2 from neuraminidase__InfluenzaA__AFN19410

SEQ ID NO: 114460 - RNA, 1410 nt, Artificial Sequence; identical to SEQ ID NO: 114434
  derived and/or modified sequence opt2 from neuraminidase__InfluenzaA__AFN19412

SEQ ID NO: 114461 - RNA, 1410 nt, Artificial Sequence; identical to SEQ ID NO: 114434
  derived and/or modified sequence opt2 from neuraminidase__InfluenzaA__AFN19414

SEQ ID NO: 114462 - RNA, 1410 nt, Artificial Sequence; identical to SEQ ID NO: 114434
  derived and/or modified sequence opt2 from neuraminidase__InfluenzaA__AFN19416

SEQ ID NO: 114463 - RNA, 1410 nt, Artificial Sequence
  derived and/or modified sequence opt2 from neuraminidase__InfluenzaA__AFN19418
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggccgcgccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114464 - RNA, 1410 nt, Artificial Sequence
  derived and/or modified sequence opt2 from neuraminidase__InfluenzaA__AFN19420
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114465 - RNA, 1410 nt, Artificial Sequence
  derived and/or modified sequence opt2 from neuraminidase__InfluenzaA__AFN19422
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcaacgacaagaacgccaccgccuccuucaucuacaacggccgccucgucgacuccgucgucuccugguccaaggagguccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114466 - RNA, 1410 nt, Artificial Sequence
  derived and/or modified sequence opt2 from neuraminidase__InfluenzaA__AFN19426
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacgagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114467 - RNA, 1410 nt, Artificial Sequence; identical to SEQ ID NO: 114434
  derived and/or modified sequence opt2 from neuraminidase__InfluenzaA__AFN19428

SEQ ID NO: 114468 - RNA, 1410 nt, Artificial Sequence
  derived and/or modified sequence opt2 from neuraminidase__InfluenzaA__AFN19430
augaaccccaaccagaagaucaucaccaucggcuccgucucccucaccaucuccaccaucugcuucuucaugcagaucgccauccucaucaucaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114469 - RNA, 1410 nt, Artificial Sequence
  derived and/or modified sequence opt2 from neuraminidase__InfluenzaA__AFN19432
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcaccccccaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114470 - RNA, 1410 nt, Artificial Sequence
  derived and/or modified sequence opt2 from neuraminidase__InfluenzaA__AFN19434
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114471 - RNA, 1410 nt, Artificial Sequence; identical to SEQ ID NO: 113658
  derived and/or modified sequence opt2 from neuraminidase__InfluenzaA__AFN19436

SEQ ID NO: 114472 - RNA, 1410 nt, Artificial Sequence
  derived and/or modified sequence opt2 from neuraminidase__InfluenzaA__AFN19438
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucauguccaucuga

SEQ ID NO: 114473 - RNA, 1410 nt, Artificial Sequence
  derived and/or modified sequence opt2 from neuraminidase__InfluenzaA__AFN19442
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaucaucgagaaggagaucugccccaagcccaccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcacaucuga

SEQ ID NO: 114474 - RNA, 1410 nt, Artificial Sequence; identical to SEQ ID NO: 113658
  derived and/or modified sequence opt2 from neuraminidase__InfluenzaA__AFN19446

SEQ ID NO: 114475 - RNA, 1410 nt, Artificial Sequence; identical to SEQ ID NO: 113658
  derived and/or modified sequence opt2 from neuraminidase__InfluenzaA__AFN19448

SEQ ID NO: 114476 - RNA, 1410 nt, Artificial Sequence; identical to SEQ ID NO: 114434
  derived and/or modified sequence opt2 from neuraminidase__InfluenzaA__AFN19458

SEQ ID NO: 114477 - RNA, 1410 nt, Artificial Sequence
  derived and/or modified sequence opt2 from neuraminidase__InfluenzaA__AFN19460
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaacgagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 114478 - RNA, 1410 nt, Artificial Sequence; identical to SEQ ID NO: 113658
  derived and/or modified sequence opt2 from neuraminidase__InfluenzaA__AFN19462

SEQ ID NO: 114479 - RNA, 1410 nt, Artificial Sequence
  derived and/or modified sequence opt2 from neuraminidase__InfluenzaA__AFN19466
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucgccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114480 - RNA, 1410 nt, Artificial Sequence; identical to SEQ ID NO: 113658
  derived and/or modified sequence opt2 from neuraminidase__InfluenzaA__AFN19468

SEQ ID NO: 114481 - RNA, 1410 nt, Artificial Sequence
  derived and/or modified sequence opt2 from neuraminidase__InfluenzaA__AFN19470
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucaacaaguccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114482 - RNA, 1410 nt, Artificial Sequence; identical to SEQ ID NO: 114434
  derived and/or modified sequence opt2 from neuraminidase__InfluenzaA__AFN19472

SEQ ID NO: 114483 - RNA, 1410 nt, Artificial Sequence
  derived and/or modified sequence opt2 from neuraminidase__InfluenzaA__AFN19476
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgccccccucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114484 - RNA, 1410 nt, Artificial Sequence; identical to SEQ ID NO: 114434
  derived and/or modified sequence opt2 from neuraminidase__InfluenzaA__AFN19478

SEQ ID NO: 114485 - RNA, 1410 nt, Artificial Sequence
  derived and/or modified sequence opt2 from neuraminidase__InfluenzaA__AFN19480
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgucggcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114486 - RNA, 1410 nt, Artificial Sequence
  derived and/or modified sequence opt2 from neuraminidase__InfluenzaA__AFN19482
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccaaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114487 - RNA, 1410 nt, Artificial Sequence; identical to SEQ ID NO: 113658
  derived and/or modified sequence opt2 from neuraminidase__InfluenzaA__AFN19484

SEQ ID NO: 114488 - RNA, 1410 nt, Artificial Sequence; identical to SEQ ID NO: 114434
  derived and/or modified sequence opt2 from neuraminidase__InfluenzaA__AFN19488

SEQ ID NO: 114489 - RNA, 1410 nt, Artificial Sequence
  derived and/or modified sequence opt2 from neuraminidase__InfluenzaA__AFN19492
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114490 - RNA, 1410 nt, Artificial Sequence
  derived and/or modified sequence opt2 from neuraminidase__InfluenzaA__AFN19494
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114491 - RNA, 1410 nt, Artificial Sequence; identical to SEQ ID NO: 113299
  derived and/or modified sequence opt2 from neuraminidase__InfluenzaA__AFN19496

SEQ ID NO: 114492 - RNA, 1410 nt, Artificial Sequence
  derived and/or modified sequence opt2 from neuraminidase__InfluenzaA__AFN19498
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaccgaggagaccgagguccucuggaccuccaacuccaucgucgucuucugcggcaccuccggcaccuacggcaccggcuccuggcccgacggcgccgaccucaaccucaugcccaucuga

SEQ ID NO: 114493 - RNA, 1410 nt, Artificial Sequence; identical to SEQ ID NO: 114442
  derived and/or modified sequence opt2 from neuraminidase__InfluenzaA__AFN19500

SEQ ID NO: 114494 - RNA, 1410 nt, Artificial Sequence; identical to SEQ ID NO: 114434
  derived and/or modified sequence opt2 from neuraminidase__InfluenzaA__AFN19502

SEQ ID NO: 114495 - RNA, 1410 nt, Artificial Sequence; identical to SEQ ID NO: 111030
  derived and/or modified sequence opt2 from neuraminidase__InfluenzaA__AFN19504

SEQ ID NO: 114496 - RNA, 1410 nt, Artificial Sequence; identical to SEQ ID NO: 111030
  derived and/or modified sequence opt2 from neuraminidase__InfluenzaA__AFN19506

SEQ ID NO: 114497 - RNA, 1410 nt, Artificial Sequence; identical to SEQ ID NO: 114442
  derived and/or modified sequence opt2 from neuraminidase__InfluenzaA__AFN19508

SEQ ID NO: 114498 - RNA, 1410 nt, Artificial Sequence; identical to SEQ ID NO: 114434
  derived and/or modified sequence opt2 from neuraminidase__InfluenzaA__AFN19510

SEQ ID NO: 114499 - RNA, 1410 nt, Artificial Sequence; identical to SEQ ID NO: 114434
  derived and/or modified sequence opt2 from neuraminidase__InfluenzaA__AFN19512

SEQ ID NO: 114500 - RNA, 1410 nt, Artificial Sequence; identical to SEQ ID NO: 114434
  derived and/or modified sequence opt2 from neuraminidase__InfluenzaA__AFN19516

SEQ ID NO: 114501 - RNA, 1410 nt, Artificial Sequence; identical to SEQ ID NO: 114442
  derived and/or modified sequence opt2 from neuraminidase__InfluenzaA__AFN19518

SEQ ID NO: 114502 - RNA, 1410 nt, Artificial Sequence; identical to SEQ ID NO: 114442
  derived and/or modified sequence opt2 from neuraminidase__InfluenzaA__AFN19520

SEQ ID NO: 114503 - RNA, 1410 nt, Artificial Sequence; identical to SEQ ID NO: 114434
  derived and/or modified sequence opt2 from neuraminidase__InfluenzaA__AFN19522

SEQ ID NO: 114504 - RNA, 1410 nt, Artificial Sequence
  derived and/or modified sequence opt2 from neuraminidase__InfluenzaA__AFN19524
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucucccucaugcccaucuga

SEQ ID NO: 114505 - RNA, 1410 nt, Artificial Sequence
  derived and/or modified sequence opt2 from neuraminidase__InfluenzaA__AFN19526
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaccgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114506 - RNA, 1410 nt, Artificial Sequence
  derived and/or modified sequence opt2 from neuraminidase__InfluenzaA__AFN19528
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaguccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114507 - RNA, 1410 nt, Artificial Sequence; identical to SEQ ID NO: 114470
  derived and/or modified sequence opt2 from neuraminidase__InfluenzaA__AFN19530

SEQ ID NO: 114508 - RNA, 1410 nt, Artificial Sequence; identical to SEQ ID NO: 114434
  derived and/or modified sequence opt2 from neuraminidase__InfluenzaA__AFN19532

SEQ ID NO: 114509 - RNA, 1410 nt, Artificial Sequence; identical to SEQ ID NO: 114470
  derived and/or modified sequence opt2 from neuraminidase__InfluenzaA__AFN19534

SEQ ID NO: 114510 - RNA, 1410 nt, Artificial Sequence; identical to SEQ ID NO: 114434
  derived and/or modified sequence opt2 from neuraminidase__InfluenzaA__AFN19536

SEQ ID NO: 114511 - RNA, 1410 nt, Artificial Sequence; identical to SEQ ID NO: 114434
  derived and/or modified sequence opt2 from neuraminidase__InfluenzaA__AFN19538

SEQ ID NO: 114512 - RNA, 1410 nt, Artificial Sequence; identical to SEQ ID NO: 114434
  derived and/or modified sequence opt2 from neuraminidase__InfluenzaA__AFN19544

SEQ ID NO: 114513 - RNA, 1410 nt, Artificial Sequence
  derived and/or modified sequence opt2 from neuraminidase__InfluenzaA__AFN19546
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucauguccgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114514 - RNA, 1410 nt, Artificial Sequence
  derived and/or modified sequence opt2 from neuraminidase__InfluenzaA__AFN19548
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114515 - RNA, 1410 nt, Artificial Sequence
  derived and/or modified sequence opt2 from neuraminidase__InfluenzaA__AFN19550
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114516 - RNA, 1410 nt, Artificial Sequence; identical to SEQ ID NO: 114434
  derived and/or modified sequence opt2 from neuraminidase__InfluenzaA__AFN19552

SEQ ID NO: 114517 - RNA, 1410 nt, Artificial Sequence; identical to SEQ ID NO: 113658
  derived and/or modified sequence opt2 from neuraminidase__InfluenzaA__AFN19554

SEQ ID NO: 114518 - RNA, 1410 nt, Artificial Sequence; identical to SEQ ID NO: 113658
  derived and/or modified sequence opt2 from neuraminidase__InfluenzaA__AFN19556

SEQ ID NO: 114519 - RNA, 1410 nt, Artificial Sequence
  derived and/or modified sequence opt2 from neuraminidase__InfluenzaA__AFN19558
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaugaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114520 - RNA, 1410 nt, Artificial Sequence
  derived and/or modified sequence opt2 from neuraminidase__InfluenzaA__AFN19560
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgagggcggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114521 - RNA, 1410 nt, Artificial Sequence; identical to SEQ ID NO: 114481
  derived and/or modified sequence opt2 from neuraminidase__InfluenzaA__AFN19562

SEQ ID NO: 114522 - RNA, 1410 nt, Artificial Sequence
  derived and/or modified sequence opt2 from neuraminidase__InfluenzaA__AFN19564
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114523 - RNA, 1410 nt, Artificial Sequence
  derived and/or modified sequence opt2 from neuraminidase__InfluenzaA__AFN19566
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaacgagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 114524 - RNA, 1410 nt, Artificial Sequence
  derived and/or modified sequence opt2 from neuraminidase__InfluenzaA__AFN19568
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccaggucaaccgccaggucaucgucgaccgcggcgaccgcuccggcuacuccggcaucuucuccgucgagggcaaguccugcaucaaccgcugcuucuacgucgagcucauccgcggccgcaaggaggagaucgagguccucuggaccuccaacuccaucgucgucuucugcggcaccuccggcaccuacggcaccggcuccuggcccgacggcgccgaccucaaccucaugcccaucuga

SEQ ID NO: 114525 - RNA, 1410 nt, Artificial Sequence
  derived and/or modified sequence opt2 from neuraminidase__InfluenzaA__AFN19570
augaaccccaaccagaagaucaucaccaucggcuccgucucccucaccaucuccaccaucugcuucuucaugcagaucgccauccucaucaccaccgucacccuccacuucaagcaguacgaguucaacuacccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaacgagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 114526 - RNA, 1410 nt, Artificial Sequence
  derived and/or modified sequence opt2 from neuraminidase__InfluenzaA__AFN19572
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgcaucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114527 - RNA, 1410 nt, Artificial Sequence
  derived and/or modified sequence opt2 from neuraminidase__InfluenzaA__AFN19574
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggcuccaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114528 - RNA, 1410 nt, Artificial Sequence
  derived and/or modified sequence opt2 from neuraminidase__InfluenzaA__AFN19576
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114529 - RNA, 1410 nt, Artificial Sequence; identical to SEQ ID NO: 114434
  derived and/or modified sequence opt2 from neuraminidase__InfluenzaA__AFN19578

SEQ ID NO: 114530 - RNA, 1410 nt, Artificial Sequence; identical to SEQ ID NO: 114434
  derived and/or modified sequence opt2 from neuraminidase__InfluenzaA__AFN19582

SEQ ID NO: 114531 - RNA, 1410 nt, Artificial Sequence; identical to SEQ ID NO: 114434
  derived and/or modified sequence opt2 from neuraminidase__InfluenzaA__AFN19584

SEQ ID NO: 114532 - RNA, 1410 nt, Artificial Sequence; identical to SEQ ID NO: 114434
  derived and/or modified sequence opt2 from neuraminidase__InfluenzaA__AFN19588

SEQ ID NO: 114533 - RNA, 1410 nt, Artificial Sequence; identical to SEQ ID NO: 114434
  derived and/or modified sequence opt2 from neuraminidase__InfluenzaA__AFN19590

SEQ ID NO: 114534 - RNA, 1410 nt, Artificial Sequence; identical to SEQ ID NO: 114470
  derived and/or modified sequence opt2 from neuraminidase__InfluenzaA__AFN19592

SEQ ID NO: 114535 - RNA, 1410 nt, Artificial Sequence; identical to SEQ ID NO: 114434
  derived and/or modified sequence opt2 from neuraminidase__InfluenzaA__AFN19594

SEQ ID NO: 114536 - RNA, 1410 nt, Artificial Sequence; identical to SEQ ID NO: 114442
  derived and/or modified sequence opt2 from neuraminidase__InfluenzaA__AFN19596

SEQ ID NO: 114537 - RNA, 1410 nt, Artificial Sequence; identical to SEQ ID NO: 114442
  derived and/or modified sequence opt2 from neuraminidase__InfluenzaA__AFN19600

SEQ ID NO: 114538 - RNA, 1410 nt, Artificial Sequence
  derived and/or modified sequence opt2 from neuraminidase__InfluenzaA__AFN19602
augaaccccaaccagaagaucaucaccaucggcuccgucucccucacccucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114539 - RNA, 1410 nt, Artificial Sequence; identical to SEQ ID NO: 114434
  derived and/or modified sequence opt2 from neuraminidase__InfluenzaA__AFN19604

SEQ ID NO: 114540 - RNA, 1410 nt, Artificial Sequence; identical to SEQ ID NO: 114434
  derived and/or modified sequence opt2 from neuraminidase__InfluenzaA__AFN19606

SEQ ID NO: 114541 - RNA, 1410 nt, Artificial Sequence; identical to SEQ ID NO: 114434
  derived and/or modified sequence opt2 from neuraminidase__InfluenzaA__AFN19608

SEQ ID NO: 114542 - RNA, 1410 nt, Artificial Sequence; identical to SEQ ID NO: 114434
  derived and/or modified sequence opt2 from neuraminidase__InfluenzaA__AFN19610

SEQ ID NO: 114543 - RNA, 1410 nt, Artificial Sequence; identical to SEQ ID NO: 114442
  derived and/or modified sequence opt2 from neuraminidase__InfluenzaA__AFN19612

SEQ ID NO: 114544 - RNA, 1410 nt, Artificial Sequence; identical to SEQ ID NO: 113658
  derived and/or modified sequence opt2 from neuraminidase__InfluenzaA__AFN19614

SEQ ID NO: 114545 - RNA, 1410 nt, Artificial Sequence
  derived and/or modified sequence opt2 from neuraminidase__InfluenzaA__AFN19618
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaacgagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114546 - RNA, 1410 nt, Artificial Sequence; identical to SEQ ID NO: 114434
  derived and/or modified sequence opt2 from neuraminidase__InfluenzaA__AFN19620

SEQ ID NO: 114547 - RNA, 1410 nt, Artificial Sequence; identical to SEQ ID NO: 114470
  derived and/or modified sequence opt2 from neuraminidase__InfluenzaA__AFN19624

SEQ ID NO: 114548 - RNA, 1410 nt, Artificial Sequence; identical to SEQ ID NO: 114434
  derived and/or modified sequence opt2 from neuraminidase__InfluenzaA__AFN19630

SEQ ID NO: 114549 - RNA, 1410 nt, Artificial Sequence
  derived and/or modified sequence opt2 from neuraminidase__InfluenzaA__AFN19632
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccaccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114550 - RNA, 1410 nt, Artificial Sequence
  derived and/or modified sequence opt2 from neuraminidase__InfluenzaA__AFN19634
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcaccuccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114551 - RNA, 1410 nt, Artificial Sequence
  derived and/or modified sequence opt2 from neuraminidase__InfluenzaA__AFN19636
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaucaucgagaaggagaucugccccaagcccaccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114552 - RNA, 1410 nt, Artificial Sequence; identical to SEQ ID NO: 114551
  derived and/or modified sequence opt2 from neuraminidase__InfluenzaA__AFN19638

SEQ ID NO: 114553 - RNA, 1410 nt, Artificial Sequence; identical to SEQ ID NO: 114434
  derived and/or modified sequence opt2 from neuraminidase__InfluenzaA__AFN19640

SEQ ID NO: 114554 - RNA, 1410 nt, Artificial Sequence
  derived and/or modified sequence opt2 from neuraminidase__InfluenzaA__AFN19642
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgucuccgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114555 - RNA, 1410 nt, Artificial Sequence; identical to SEQ ID NO: 114551
  derived and/or modified sequence opt2 from neuraminidase__InfluenzaA__AFN19644

SEQ ID NO: 114556 - RNA, 1410 nt, Artificial Sequence
  derived and/or modified sequence opt2 from neuraminidase__InfluenzaA__AFN19646
augaaccccaaccagaagaucaucaccaucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucaaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114557 - RNA, 1410 nt, Artificial Sequence; identical to SEQ ID NO: 114434
  derived and/or modified sequence opt2 from neuraminidase__InfluenzaA__AFN19648

SEQ ID NO: 114558 - RNA, 1410 nt, Artificial Sequence; identical to SEQ ID NO: 114470
  derived and/or modified sequence opt2 from neuraminidase__InfluenzaA__AFN19650

SEQ ID NO: 114559 - RNA, 1410 nt, Artificial Sequence
  derived and/or modified sequence opt2 from neuraminidase__InfluenzaA__AFN19652
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgaggucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114560 - RNA, 1410 nt, Artificial Sequence
  derived and/or modified sequence opt2 from neuraminidase__InfluenzaA__AFN19654
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaccugccccaagcccaccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114561 - RNA, 1410 nt, Artificial Sequence; identical to SEQ ID NO: 114434
  derived and/or modified sequence opt2 from neuraminidase__InfluenzaA__AFN19656

SEQ ID NO: 114562 - RNA, 1410 nt, Artificial Sequence; identical to SEQ ID NO: 113658
  derived and/or modified sequence opt2 from neuraminidase__InfluenzaA__AFN19658

SEQ ID NO: 114563 - RNA, 1410 nt, Artificial Sequence; identical to SEQ ID NO: 114551
  derived and/or modified sequence opt2 from neuraminidase__InfluenzaA__AFN19660

SEQ ID NO: 114564 - RNA, 1410 nt, Artificial Sequence; identical to SEQ ID NO: 113658
  derived and/or modified sequence opt2 from neuraminidase__InfluenzaA__AFN19662

SEQ ID NO: 114565 - RNA, 1410 nt, Artificial Sequence
  derived and/or modified sequence opt2 from neuraminidase__InfluenzaA__AFN19664
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaacaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114566 - RNA, 1410 nt, Artificial Sequence
  derived and/or modified sequence opt2 from neuraminidase__InfluenzaA__AFN19666
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucaaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114567 - RNA, 1410 nt, Artificial Sequence
  derived and/or modified sequence opt2 from neuraminidase__InfluenzaA__AFN19668
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacgagcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114568 - RNA, 1410 nt, Artificial Sequence; identical to SEQ ID NO: 114470
  derived and/or modified sequence opt2 from neuraminidase__InfluenzaA__AFN19670

SEQ ID NO: 114569 - RNA, 1410 nt, Artificial Sequence; identical to SEQ ID NO: 113658
  derived and/or modified sequence opt2 from neuraminidase__InfluenzaA__AFN19673

SEQ ID NO: 114570 - RNA, 1410 nt, Artificial Sequence; identical to SEQ ID NO: 114434
  derived and/or modified sequence opt2 from neuraminidase__InfluenzaA__AFN19675

SEQ ID NO: 114571 - RNA, 1410 nt, Artificial Sequence
  derived and/or modified sequence opt2 from neuraminidase__InfluenzaA__AFN19677
augaaccccaaccagaagaucaucaccaucggcuccgucucccucaccaucuccaucaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114572 - RNA, 1410 nt, Artificial Sequence; identical to SEQ ID NO: 114470
  derived and/or modified sequence opt2 from neuraminidase__InfluenzaA__AFN19683

SEQ ID NO: 114573 - RNA, 1410 nt, Artificial Sequence; identical to SEQ ID NO: 114434
  derived and/or modified sequence opt2 from neuraminidase__InfluenzaA__AFN19685

SEQ ID NO: 114574 - RNA, 1410 nt, Artificial Sequence; identical to SEQ ID NO: 114434
  derived and/or modified sequence opt2 from neuraminidase__InfluenzaA__AFN19687

SEQ ID NO: 114575 - RNA, 1410 nt, Artificial Sequence; identical to SEQ ID NO: 114434
  derived and/or modified sequence opt2 from neuraminidase__InfluenzaA__AFN19689

SEQ ID NO: 114576 - RNA, 1410 nt, Artificial Sequence; identical to SEQ ID NO: 113658
  derived and/or modified sequence opt2 from neuraminidase__InfluenzaA__AFN19691

SEQ ID NO: 114577 - RNA, 1410 nt, Artificial Sequence
  derived and/or modified sequence opt2 from neuraminidase__InfluenzaA__AFN19693
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccuccaacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114578 - RNA, 1410 nt, Artificial Sequence
  derived and/or modified sequence opt2 from neuraminidase__InfluenzaA__AFN19697
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagacccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114579 - RNA, 1410 nt, Artificial Sequence; identical to SEQ ID NO: 114434
  derived and/or modified sequence opt2 from neuraminidase__InfluenzaA__AFN19699

SEQ ID NO: 114580 - RNA, 1410 nt, Artificial Sequence; identical to SEQ ID NO: 114470
  derived and/or modified sequence opt2 from neuraminidase__InfluenzaA__AFN19701

SEQ ID NO: 114581 - RNA, 1410 nt, Artificial Sequence
  derived and/or modified sequence opt2 from neuraminidase__InfluenzaA__AFN19703
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucgacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114582 - RNA, 1410 nt, Artificial Sequence; identical to SEQ ID NO: 111769
  derived and/or modified sequence opt2 from neuraminidase__InfluenzaA__AFN19711

SEQ ID NO: 114583 - RNA, 1410 nt, Artificial Sequence
  derived and/or modified sequence opt2 from neuraminidase__InfluenzaA__AFN19721
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccauggagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114584 - RNA, 1410 nt, Artificial Sequence; identical to SEQ ID NO: 112590
  derived and/or modified sequence opt2 from neuraminidase__InfluenzaA__AFN19731

SEQ ID NO: 114585 - RNA, 1410 nt, Artificial Sequence; identical to SEQ ID NO: 111769
  derived and/or modified sequence opt2 from neuraminidase__InfluenzaA__AFN19737

SEQ ID NO: 114586 - RNA, 1410 nt, Artificial Sequence
  derived and/or modified sequence opt2 from neuraminidase__InfluenzaA__AFN19747
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucacccacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcgccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114587 - RNA, 1410 nt, Artificial Sequence; identical to SEQ ID NO: 111769
  derived and/or modified sequence opt2 from neuraminidase__InfluenzaA__AFN19749

SEQ ID NO: 114588 - RNA, 1410 nt, Artificial Sequence; identical to SEQ ID NO: 111769
  derived and/or modified sequence opt2 from neuraminidase__InfluenzaA__AFN19759

SEQ ID NO: 114589 - RNA, 1410 nt, Artificial Sequence
  derived and/or modified sequence opt2 from neuraminidase__InfluenzaA__AFN19769
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaaccgcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114590 - RNA, 1410 nt, Artificial Sequence; identical to SEQ ID NO: 111769
  derived and/or modified sequence opt2 from neuraminidase__InfluenzaA__AFN19783

SEQ ID NO: 114591 - RNA, 1410 nt, Artificial Sequence; identical to SEQ ID NO: 112470
  derived and/or modified sequence opt2 from neuraminidase__InfluenzaA__AFN19793

SEQ ID NO: 114592 - RNA, 1410 nt, Artificial Sequence; identical to SEQ ID NO: 111769
  derived and/or modified sequence opt2 from neuraminidase__InfluenzaA__AFN19807

SEQ ID NO: 114593 - RNA, 1410 nt, Artificial Sequence
  derived and/or modified sequence opt2 from neuraminidase__InfluenzaA__AFN19809
augaaccccaaccagaagaucaucaccaucggcuccgucugcaugaucaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucaucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccaccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114594 - RNA, 1410 nt, Artificial Sequence; identical to SEQ ID NO: 112592
  derived and/or modified sequence opt2 from neuraminidase__InfluenzaA__AFN19815

SEQ ID NO: 114595 - RNA, 1410 nt, Artificial Sequence
  derived and/or modified sequence opt2 from neuraminidase__InfluenzaA__AFN19833
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114596 - RNA, 1410 nt, Artificial Sequence; identical to SEQ ID NO: 112228
  derived and/or modified sequence opt2 from neuraminidase__InfluenzaA__AFN19851

SEQ ID NO: 114597 - RNA, 1410 nt, Artificial Sequence; identical to SEQ ID NO: 111769
  derived and/or modified sequence opt2 from neuraminidase__InfluenzaA__AFN19857

SEQ ID NO: 114598 - RNA, 1410 nt, Artificial Sequence
  derived and/or modified sequence opt2 from neuraminidase__InfluenzaA__AFN19867
augaaccccaaccagaagaucaucaccaucggcuccgucugcaugaccaucggcauggccaaccucauccuccagaucggcaacaucaucuccaucuggaucucccacuccauccagaucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaucaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114599 - RNA, 1410 nt, Artificial Sequence; identical to SEQ ID NO: 112221
  derived and/or modified sequence opt2 from neuraminidase__InfluenzaA__AFN19877

SEQ ID NO: 114600 - RNA, 1410 nt, Artificial Sequence; identical to SEQ ID NO: 111769
  derived and/or modified sequence opt2 from neuraminidase__InfluenzaA__AFN19887

SEQ ID NO: 114601 - RNA, 1410 nt, Artificial Sequence
  derived and/or modified sequence opt2 from neuraminidase__InfluenzaA__AFN19897
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccugcaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114602 - RNA, 1410 nt, Artificial Sequence; identical to SEQ ID NO: 111769
  derived and/or modified sequence opt2 from neuraminidase__InfluenzaA__AFN19907

SEQ ID NO: 114603 - RNA, 1410 nt, Artificial Sequence; identical to SEQ ID NO: 112228
  derived and/or modified sequence opt2 from neuraminidase__InfluenzaA__AFN19917

SEQ ID NO: 114604 - RNA, 1410 nt, Artificial Sequence
  derived and/or modified sequence opt2 from neuraminidase__InfluenzaA__AFN19923
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccagaacgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114605 - RNA, 1410 nt, Artificial Sequence; identical to SEQ ID NO: 111769
  derived and/or modified sequence opt2 from neuraminidase__InfluenzaA__AFN19933

SEQ ID NO: 114606 - RNA, 1410 nt, Artificial Sequence; identical to SEQ ID NO: 112228
  derived and/or modified sequence opt2 from neuraminidase__InfluenzaA__AFN19943

SEQ ID NO: 114607 - RNA, 1410 nt, Artificial Sequence
  derived and/or modified sequence opt2 from neuraminidase__InfluenzaA__AFN19953
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccagcgcgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucgagaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114608 - RNA, 1410 nt, Artificial Sequence
  derived and/or modified sequence opt2 from neuraminidase__InfluenzaA__AFN19967
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcuccaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114609 - RNA, 1410 nt, Artificial Sequence
  derived and/or modified sequence opt2 from neuraminidase__InfluenzaA__AFN19973
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggcuccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114610 - RNA, 1410 nt, Artificial Sequence; identical to SEQ ID NO: 111769
  derived and/or modified sequence opt2 from neuraminidase__InfluenzaA__AFN19979

SEQ ID NO: 114611 - RNA, 1410 nt, Artificial Sequence
  derived and/or modified sequence opt2 from neuraminidase__InfluenzaA__AFN19985
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccgucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114612 - RNA, 1410 nt, Artificial Sequence
  derived and/or modified sequence opt2 from neuraminidase__InfluenzaA__AFN19995
augaaccccaaccagaagaucaucaccaucggcuccgucugcaugaccaucggcauggccaaccucauccuccagaucggcaacaucaucuccaucuggaucucccacuccauccagcucggcaaccagucccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114613 - RNA, 1410 nt, Artificial Sequence; identical to SEQ ID NO: 111769
  derived and/or modified sequence opt2 from neuraminidase__InfluenzaA__AFN20001

SEQ ID NO: 114614 - RNA, 1410 nt, Artificial Sequence
  derived and/or modified sequence opt2 from neuraminidase__InfluenzaA__AFN20013
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcgaccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114615 - RNA, 1410 nt, Artificial Sequence
  derived and/or modified sequence opt2 from neuraminidase__InfluenzaA__AFN20020
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggccucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114616 - RNA, 1410 nt, Artificial Sequence; identical to SEQ ID NO: 111769
  derived and/or modified sequence opt2 from neuraminidase__InfluenzaA__AFN20022

SEQ ID NO: 114617 - RNA, 1410 nt, Artificial Sequence
  derived and/or modified sequence opt2 from neuraminidase__InfluenzaA__AFN20035
augaaccccaaccagaagaucaucaccaucggcuccgucugcaugaccaucggcaucgccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114618 - RNA, 1410 nt, Artificial Sequence; identical to SEQ ID NO: 111769
  derived and/or modified sequence opt2 from neuraminidase__InfluenzaA__AFN20041

SEQ ID NO: 114619 - RNA, 1410 nt, Artificial Sequence; identical to SEQ ID NO: 111769
  derived and/or modified sequence opt2 from neuraminidase__InfluenzaA__AFN20047

SEQ ID NO: 114620 - RNA, 1410 nt, Artificial Sequence; identical to SEQ ID NO: 112592
  derived and/or modified sequence opt2 from neuraminidase__InfluenzaA__AFN20063

SEQ ID NO: 114621 - RNA, 1410 nt, Artificial Sequence
  derived and/or modified sequence opt2 from neuraminidase__InfluenzaA__AFN20077
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114622 - RNA, 1410 nt, Artificial Sequence; identical to SEQ ID NO: 111769
  derived and/or modified sequence opt2 from neuraminidase__InfluenzaA__AFN20083

SEQ ID NO: 114623 - RNA, 1410 nt, Artificial Sequence
  derived and/or modified sequence opt2 from neuraminidase__InfluenzaA__AFN20094
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaucuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaaggccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccaugggcugguccuggcccgacggcgccgagcuccccuucaccaucgacaaguga

SEQ ID NO: 114624 - RNA, 1410 nt, Artificial Sequence; identical to SEQ ID NO: 112228
  derived and/or modified sequence opt2 from neuraminidase__InfluenzaA__AFN20100

SEQ ID NO: 114625 - RNA, 1410 nt, Artificial Sequence
  derived and/or modified sequence opt2 from neuraminidase__InfluenzaA__AFN20114
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcucccccgucuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacuccuucuccaugaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 114626 - RNA, 1410 nt, Artificial Sequence
  derived and/or modified sequence opt2 from neuraminidase__InfluenzaA__AFN20128
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccauccgcuccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcuccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114627 - RNA, 1410 nt, Artificial Sequence; identical to SEQ ID NO: 111769
  derived and/or modified sequence opt2 from neuraminidase__InfluenzaA__AFN87935

SEQ ID NO: 114628 - RNA, 1410 nt, Artificial Sequence
  derived and/or modified sequence opt2 from neuraminidase__InfluenzaA__AFN87937
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacuccuucuccaugaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 114629 - RNA, 1410 nt, Artificial Sequence
  derived and/or modified sequence opt2 from neuraminidase__InfluenzaA__AFN87940
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114630 - RNA, 1410 nt, Artificial Sequence; identical to SEQ ID NO: 108250
  derived and/or modified sequence opt2 from neuraminidase__InfluenzaA__AFN87942

SEQ ID NO: 114631 - RNA, 1410 nt, Artificial Sequence; identical to SEQ ID NO: 114628
  derived and/or modified sequence opt2 from neuraminidase__InfluenzaA__AFN87944

SEQ ID NO: 114632 - RNA, 1410 nt, Artificial Sequence
  derived and/or modified sequence opt2 from neuraminidase__InfluenzaA__AFN87946
augaaccccaaccagaagaucaucaccaucggcuccgucugcaugaccaucggcauggccaaccucacccuccagaucggcaacaucaucuccaucuggaucucccacuccauccagcucggcaaccagaaccagaucgagaccugcaaccaguccgucaucaacuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucgucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgaggucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114633 - RNA, 1410 nt, Artificial Sequence
  derived and/or modified sequence opt2 from neuraminidase__InfluenzaA__AFN87948
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaucgucggcugguccuggcccgacggcgccgagcuccccuucaccaucgacaaguga

SEQ ID NO: 114634 - RNA, 1410 nt, Artificial Sequence
  derived and/or modified sequence opt2 from neuraminidase__InfluenzaA__AFN87950
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucaaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114635 - RNA, 1410 nt, Artificial Sequence; identical to SEQ ID NO: 112221
  derived and/or modified sequence opt2 from neuraminidase__InfluenzaA__AFN87952

SEQ ID NO: 114636 - RNA, 1410 nt, Artificial Sequence
  derived and/or modified sequence opt2 from neuraminidase__InfluenzaA__AFN87954
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccaugggcugguccuggcccgacggcgccgagcuccccuucaccaucgacaaguga

SEQ ID NO: 114637 - RNA, 1410 nt, Artificial Sequence
  derived and/or modified sequence opt2 from neuraminidase__InfluenzaA__AFN87956
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaacuga

SEQ ID NO: 114638 - RNA, 1410 nt, Artificial Sequence
  derived and/or modified sequence opt2 from neuraminidase__InfluenzaA__AFN87958
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgccuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacuccuucuccaugaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 114639 - RNA, 1410 nt, Artificial Sequence
  derived and/or modified sequence opt2 from neuraminidase__InfluenzaA__AFN87960
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucuggaucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114640 - RNA, 1413 nt, Artificial Sequence
  derived and/or modified sequence opt2 from neuraminidase__InfluenzaA__AFO64805
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccaacaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114641 - RNA, 1413 nt, Artificial Sequence
  derived and/or modified sequence opt2 from neuraminidase__InfluenzaA__AFO64816
augaaccccaaccagaagaucaucaccaucggcuccaucugcauggccaucggcaucaucucccucauccuccagaucggcaacaucgucuccaucuggaucucccacuccauccagaccggcucccagaacuacaccggcaucugcaaccagcgcaucaucaccuacgagaacuccaccugggucaaccagaccuacgucaacaucaacaacaccaacgucgucgccggccaggacaccaccuccgucgcccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgccgccgcauccuccgcacccaggaguccgagugcgucugcgucaacggcuccugcuucaccaucaugaccgacggccccaacaacggccccgccuccuacaagaucuucaagaucgagaagggcaaggucaccaaguccaucgagcucgacgcccccaacucccacuacgaggagugcuccugcuaccccgacgccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 114642 - RNA, 1413 nt, Artificial Sequence
  derived and/or modified sequence opt2 from neuraminidase__InfluenzaA__AFO64827
augaaccccaaccagaagaucaucaccaucggcuccaucuccauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucaucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggcaaggucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaaccgcuuccgcaagggcuucgagaugaucugggaccccaacggcuggaccgacaccgacuccgacuuccucgucaagcaggacgucgucgccaugaccgacugguccggcuacuccggcuccuucguccagcaccccgagcucaccggccucgacugcaugcgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114643 - RNA, 1413 nt, Artificial Sequence
  derived and/or modified sequence opt2 from neuraminidase__InfluenzaA__AFO64838
augaaccccaaccagaagaucaucaccaucggcuccaucuccauggccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114644 - RNA, 1413 nt, Artificial Sequence
  derived and/or modified sequence opt2 from neuraminidase__InfluenzaA__AFO64849
augaaccccaaccagaagaucaucaccaucggcuccaucuccauggccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccgucaagcaggacgucgucgccaugaccgacugguccggcuacuccggcuccuucguccagcaccccgagcucaccggccucgacugcaugcgccccugcuucugggucgagcucguccgcggccgcccccgcgagaacgccaccaucuggaccuccggcuccuccaucuccuucugcggcgucaacuccgacaccgccaacugguccuggcccgacggcgccgagcuccccuucaccaucgacaaguga

SEQ ID NO: 114645 - RNA, 1413 nt, Artificial Sequence; identical to SEQ ID NO: 106480
  derived and/or modified sequence opt2 from neuraminidase__InfluenzaA__AFO64860

SEQ ID NO: 114646 - RNA, 1413 nt, Artificial Sequence
  derived and/or modified sequence opt2 from neuraminidase__InfluenzaA__AFO64871
augaaccccaaccagaagaucaucaccaucggcuccaucuccaucgccaucggcaucaucucccucauccuccagaucggcaacaucaucuccaucugggccucccacuccauccagaccggcucccagaaccacaccggcgucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugcgccaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114647 - RNA, 1413 nt, Artificial Sequence
  derived and/or modified sequence opt2 from neuraminidase__InfluenzaA__AFO64882
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114648 - RNA, 1413 nt, Artificial Sequence
  derived and/or modified sequence opt2 from neuraminidase__InfluenzaA__AFO64893
augaaccccaaccagaagaucaucaccaucggcuccaucuccgucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccgacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgcuuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114649 - RNA, 1413 nt, Artificial Sequence
  derived and/or modified sequence opt2 from neuraminidase__InfluenzaA__AFO64904
augaaccccaaccagaagaucaucaccaucggcuccaucuccgucgccaucggcaucaucucccucauccuccagaucggcaacaucaucuccaugugggccucccacuccauccagaccggcucccagaacuacaccggcaucugcaaccagcgcaucaucaccuacgagaacaacaccugggucaaccagaccuacgucaacaucaacaacaccaacgucgucgccggcaaggacaagaucuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 114650 - RNA, 1413 nt, Artificial Sequence
  derived and/or modified sequence opt2 from neuraminidase__InfluenzaA__AFO65019
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114651 - RNA, 1413 nt, Artificial Sequence; identical to SEQ ID NO: 107965
  derived and/or modified sequence opt2 from neuraminidase__InfluenzaA__AFO65030

SEQ ID NO: 114652 - RNA, 1413 nt, Artificial Sequence
  derived and/or modified sequence opt2 from neuraminidase__InfluenzaA__AFO65041
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114653 - RNA, 1413 nt, Artificial Sequence
  derived and/or modified sequence opt2 from neuraminidase__InfluenzaA__AFO65052
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugcaacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114654 - RNA, 1413 nt, Artificial Sequence; identical to SEQ ID NO: 106340
  derived and/or modified sequence opt2 from neuraminidase__InfluenzaA__AFO66139

SEQ ID NO: 114655 - RNA, 1413 nt, Artificial Sequence
  derived and/or modified sequence opt2 from neuraminidase__InfluenzaA__AFO66150
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagcgcaucaucaccuacgagaaccgcaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgcauccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 114656 - RNA, 1413 nt, Artificial Sequence
  derived and/or modified sequence opt2 from neuraminidase__InfluenzaA__AFO66161
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaucugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 114657 - RNA, 1413 nt, Artificial Sequence
  derived and/or modified sequence opt2 from neuraminidase__InfluenzaA__AFO66172
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114658 - RNA, 1413 nt, Artificial Sequence; identical to SEQ ID NO: 106442
  derived and/or modified sequence opt2 from neuraminidase__InfluenzaA__AFO66183

SEQ ID NO: 114659 - RNA, 1413 nt, Artificial Sequence
  derived and/or modified sequence opt2 from neuraminidase__InfluenzaA__AFO66194
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 114660 - RNA, 1410 nt, Artificial Sequence; identical to SEQ ID NO: 108067
  derived and/or modified sequence opt2 from neuraminidase__InfluenzaA__AFO66205

SEQ ID NO: 114661 - RNA, 1413 nt, Artificial Sequence; identical to SEQ ID NO: 105927
  derived and/or modified sequence opt2 from neuraminidase__InfluenzaA__AFO66216

SEQ ID NO: 114662 - RNA, 1413 nt, Artificial Sequence; identical to SEQ ID NO: 105898
  derived and/or modified sequence opt2 from neuraminidase__InfluenzaA__AFO66227

SEQ ID NO: 114663 - RNA, 1413 nt, Artificial Sequence
  derived and/or modified sequence opt2 from neuraminidase__InfluenzaA__AFO66238
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114664 - RNA, 1413 nt, Artificial Sequence
  derived and/or modified sequence opt2 from neuraminidase__InfluenzaA__AFO66249
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114665 - RNA, 1413 nt, Artificial Sequence
  derived and/or modified sequence opt2 from neuraminidase__InfluenzaA__AFP33330
augaaccccaaccagaagaucaucaccaucggcuccaucuccgucgccaucggcaucaucucccucauccuccagaucggcaacaucaucuccaucugggccucccacuccauccaggccggcucccagaacuacaccggcaucugcaaccagaagaucaucaccuacgagaaccgcaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 114666 - RNA, 1413 nt, Artificial Sequence
  derived and/or modified sequence opt2 from neuraminidase__InfluenzaA__AFP33331
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114667 - RNA, 1410 nt, Artificial Sequence; identical to SEQ ID NO: 112655
  derived and/or modified sequence opt2 from neuraminidase__InfluenzaA__AFQ32576

SEQ ID NO: 114668 - RNA, 1410 nt, Artificial Sequence
  derived and/or modified sequence opt2 from neuraminidase__InfluenzaA__AFQ37282
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccggcggcuccuccaucuccuucugcggcgucaacuccgacaccgucggcugguccuggcccgacggcgccgagcuccccuucaccaucgacaaguga

SEQ ID NO: 114669 - RNA, 1410 nt, Artificial Sequence
  derived and/or modified sequence opt2 from neuraminidase__InfluenzaA__AFQ55691
augaaccccaaccagaagaucaucaccaucggcgucgucaacaccacccucuccaccaucgcccuccucaucggcgucggcaaccucgucuucaacaccgucauccacgagaagaucggcgaccaccagaccgucacccaccccaccaccaccacccccgccauccccaacugcuccgacaccaucaucaccuacaacaacaccaucaucaacaacaucaccaccaccaucaucaccgaggccgagcgccccuucaaguccccccucccccucugccccuuccgcggcuucuuccccuuccacaaggacaacgccauccgccucggcgagaacaaggacgucaucgucacccgcgagcccuacgucuccugcgacaacgacaacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcaucgccugguccuccuccuccugcuucgacggcaaggaguggaugcacgucugcaugaccggcaacgacaacgacgccuccgcccagaucaucuacgccggcaagaugaccgacuccaucaaguccuggcgcaaggacauccuccgcacccaggaguccgagugccagugcaucgacggcaccugcgucgucgccgucaccgacggccccgccgccuccuccgccgaccaccgcaucuacuggauccgcgagggcaagaucaucaaguacgaggacguccccaagaccaagauccagcaccucgaggagugcuccugcuacgucgacgucgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacgucaacggcggccccggcgucaagggcuucggcuucaaggccggcaacgacgucuggcucggccgcaccgucuccaccuccggccgcuccggcuucgagaucaucaaggucaccgagggcuggaucaacucccccaaccacgccaaguccaucacccagacccucauguccaacaacgacugguccggcuacuccggcuccuucaucaucaagaccaaggacugcuuccagcccugcuucuacgucgagcucauccgcggccgccccaacaagaacgacgacgucuccuggaccuccaacuccaucgucaccuucugcggccucgacaacgagcccggcuccggcaacuggcccgacggcuccaacaucggcuucaugcccaaguga

SEQ ID NO: 114670 - RNA, 1410 nt, Artificial Sequence
  derived and/or modified sequence opt2 from neuraminidase__InfluenzaA__AFR68156
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114671 - RNA, 1410 nt, Artificial Sequence; identical to SEQ ID NO: 114670
  derived and/or modified sequence opt2 from neuraminidase__InfluenzaA__AFR68166

SEQ ID NO: 114672 - RNA, 1410 nt, Artificial Sequence
  derived and/or modified sequence opt2 from neuraminidase__InfluenzaA__AFR68176
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgccuccugguccaaggacauccuccgcacccaggaguccgagugcgucugcaucaacggcaccugcgccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114673 - RNA, 1410 nt, Artificial Sequence; identical to SEQ ID NO: 108250
  derived and/or modified sequence opt2 from neuraminidase__InfluenzaA__AFR84677

SEQ ID NO: 114674 - RNA, 1410 nt, Artificial Sequence; identical to SEQ ID NO: 109137
  derived and/or modified sequence opt2 from neuraminidase__InfluenzaA__AFR84687

SEQ ID NO: 114675 - RNA, 1410 nt, Artificial Sequence; identical to SEQ ID NO: 108240
  derived and/or modified sequence opt2 from neuraminidase__InfluenzaA__AFR84696

SEQ ID NO: 114676 - RNA, 1410 nt, Artificial Sequence; identical to SEQ ID NO: 108250
  derived and/or modified sequence opt2 from neuraminidase__InfluenzaA__AFR84706

SEQ ID NO: 114677 - RNA, 1410 nt, Artificial Sequence; identical to SEQ ID NO: 108240
  derived and/or modified sequence opt2 from neuraminidase__InfluenzaA__AFR84716

SEQ ID NO: 114678 - RNA, 1410 nt, Artificial Sequence; identical to SEQ ID NO: 108240
  derived and/or modified sequence opt2 from neuraminidase__InfluenzaA__AFR84726

SEQ ID NO: 114679 - RNA, 1410 nt, Artificial Sequence; identical to SEQ ID NO: 108240
  derived and/or modified sequence opt2 from neuraminidase__InfluenzaA__AFR84736

SEQ ID NO: 114680 - RNA, 1410 nt, Artificial Sequence; identical to SEQ ID NO: 108240
  derived and/or modified sequence opt2 from neuraminidase__InfluenzaA__AFR84746

SEQ ID NO: 114681 - RNA, 1410 nt, Artificial Sequence; identical to SEQ ID NO: 108240
  derived and/or modified sequence opt2 from neuraminidase__InfluenzaA__AFR84756

SEQ ID NO: 114682 - RNA, 1410 nt, Artificial Sequence; identical to SEQ ID NO: 108240
  derived and/or modified sequence opt2 from neuraminidase__InfluenzaA__AFR84766

SEQ ID NO: 114683 - RNA, 1410 nt, Artificial Sequence; identical to SEQ ID NO: 108240
  derived and/or modified sequence opt2 from neuraminidase__InfluenzaA__AFR84776

SEQ ID NO: 114684 - RNA, 1410 nt, Artificial Sequence; identical to SEQ ID NO: 108240
  derived and/or modified sequence opt2 from neuraminidase__InfluenzaA__AFR84786

SEQ ID NO: 114685 - RNA, 1410 nt, Artificial Sequence; identical to SEQ ID NO: 108240
  derived and/or modified sequence opt2 from neuraminidase__InfluenzaA__AFR84796

SEQ ID NO: 114686 - RNA, 1410 nt, Artificial Sequence; identical to SEQ ID NO: 108250
  derived and/or modified sequence opt2 from neuraminidase__InfluenzaA__AFR84806

SEQ ID NO: 114687 - RNA, 1410 nt, Artificial Sequence; identical to SEQ ID NO: 108240
  derived and/or modified sequence opt2 from neuraminidase__InfluenzaA__AFR84816

SEQ ID NO: 114688 - RNA, 1410 nt, Artificial Sequence; identical to SEQ ID NO: 108250
  derived and/or modified sequence opt2 from neuraminidase__InfluenzaA__AFR84826

SEQ ID NO: 114689 - RNA, 1410 nt, Artificial Sequence
  derived and/or modified sequence opt2 from neuraminidase__InfluenzaA__AFR84836
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucggcggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114690 - RNA, 1410 nt, Artificial Sequence; identical to SEQ ID NO: 109054
  derived and/or modified sequence opt2 from neuraminidase__InfluenzaA__AFR84846

SEQ ID NO: 114691 - RNA, 1410 nt, Artificial Sequence; identical to SEQ ID NO: 108250
  derived and/or modified sequence opt2 from neuraminidase__InfluenzaA__AFR84856

SEQ ID NO: 114692 - RNA, 1410 nt, Artificial Sequence
  derived and/or modified sequence opt2 from neuraminidase__InfluenzaA__AFR84866
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuuccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114693 - RNA, 1410 nt, Artificial Sequence; identical to SEQ ID NO: 108958
  derived and/or modified sequence opt2 from neuraminidase__InfluenzaA__AFR84876

SEQ ID NO: 114694 - RNA, 1410 nt, Artificial Sequence; identical to SEQ ID NO: 109054
  derived and/or modified sequence opt2 from neuraminidase__InfluenzaA__AFR84895

SEQ ID NO: 114695 - RNA, 1410 nt, Artificial Sequence; identical to SEQ ID NO: 109054
  derived and/or modified sequence opt2 from neuraminidase__InfluenzaA__AFR84905

SEQ ID NO: 114696 - RNA, 1410 nt, Artificial Sequence; identical to SEQ ID NO: 109054
  derived and/or modified sequence opt2 from neuraminidase__InfluenzaA__AFR84915

SEQ ID NO: 114697 - RNA, 1410 nt, Artificial Sequence; identical to SEQ ID NO: 109054
  derived and/or modified sequence opt2 from neuraminidase__InfluenzaA__AFR84925

SEQ ID NO: 114698 - RNA, 1353 nt, Artificial Sequence
  derived and/or modified sequence opt2 from neuraminidase__InfluenzaA__AFU83119
augaaccccaaccagaagaucaucaccaucggcuccgucucccucaccaucgccaccgucugcuuccucaugcagaucgccauccucgccaccaccgucacccuccacuucaagcagaacgagugcuccauccccuccuccaaccaggucguccccugcgagcccaucaucgucgagcgcaacgucaccgaguaccgcgacugguccaagccccagugccagaucaccggcuucgcccccuucuccaaggacaacuccauccgccucuccgccggcggcgacaucugggucacccgcgagcccuacgucuccugcucccccgacaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacgucugcgucaccggcgacgaccgcaacgccaccgccuccuucaucuacgacggcguccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacgucuccccccucuccggcuccgcccagcacaucgaggagugcuccugcuacccccgcuaccccgacguccgcugcgucugccgcgacaacuggaagggcuccaaccgccccaucaucgacaucuccauggccgacuacggcaucgacuccuccuacgucugcuccggccucgucggcgacaccccccgcaacgacgacuccuccuccaacuccaacugcaaggaccccaacaacgagcgcggcaaccccggcgucaagggcugggccuucgacuacggcaacgacgucuggaugggccgcaccaucuccaaggacucccgcuccggcuacgagaccuuccgcgucaucggcggcuggaccaucgccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgccuucugcggcaccuccggcaccuacggcaccggcuccuggcccgacggcgccaacaucaacuucaugcccaucuga

SEQ ID NO: 114699 - RNA, 1410 nt, Artificial Sequence
  derived and/or modified sequence opt2 from neuraminidase__InfluenzaA__AFV53208
augaaccccaaccagaagaucaucaccaucggcuccgucucccucaccaucgccaccgucugcuuccucauccagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucauggacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 114700 - RNA, 1410 nt, Artificial Sequence
  derived and/or modified sequence opt2 from neuraminidase__InfluenzaA__AFV53219
augaaccccaaccagaagaccaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggagucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 114701 - RNA, 1410 nt, Artificial Sequence
  derived and/or modified sequence opt2 from neuraminidase__InfluenzaA__AFV53230
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucgucgacaucuccauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaaccucaugcccaucuga

SEQ ID NO: 114702 - RNA, 1410 nt, Artificial Sequence; identical to SEQ ID NO: 107917
  derived and/or modified sequence opt2 from neuraminidase__InfluenzaA__AFV53241

SEQ ID NO: 114703 - RNA, 1410 nt, Artificial Sequence; identical to SEQ ID NO: 105603
  derived and/or modified sequence opt2 from neuraminidase__InfluenzaA__AFV53252

SEQ ID NO: 114704 - RNA, 1413 nt, Artificial Sequence
  derived and/or modified sequence opt2 from neuraminidase__InfluenzaA__AFV53263
augaaccccaaccagaagaucaucaccaucggcuccaucugcauggccaucggcaccaucucccucauccuccagaucggcaacaucaucuccaucuggaucucccacuccauccagaccggcucccagaaccacaccggcaucugcaaccagcgcaucaucaccuacgagaacaacaccugggucaaccagaccuacgucaacaucuccaacaccaacgucgucgccggcaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaucaucaaguccuggcgcaagcagauccuccgcacccaggaguccgagugcgucugcgucaacggcuccugcuucaccaucaugaccgacggccccuccaaccgccccgccuccuaccgcaucuucaagaucgagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccaacaccgacggcaacuucuccgucaagcaggacgucgucgccaugaccgacugguccggcuacuccggcuccuucguccagcaccccgagcucaccggccucgacugcauccgccccugcuucugggucgagcucauccgcggccgcccccgcgaggagaccaccaucuggaccuccggcuccuccaucuccuucugcggcgucaacuccgacaccgucaacugguccuggcccgacggcgccgagcuccccuucaccaucgacaaguga

SEQ ID NO: 114705 - RNA, 1410 nt, Artificial Sequence
  derived and/or modified sequence opt2 from neuraminidase__InfluenzaA__AFV53274
augaaccccaaccagaagaucaucaccaucggcuccgucucccucaucaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 114706 - RNA, 1410 nt, Artificial Sequence
  derived and/or modified sequence opt2 from neuraminidase__InfluenzaA__AFV53285
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgccaccccgacguccgcugcaucugccgcgacaacuggaagggcuccaaccgccccgucaucaacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 114707 - RNA, 1410 nt, Artificial Sequence
  derived and/or modified sequence opt2 from neuraminidase__InfluenzaA__AFV53296
augaaccccaaccagaagaucaucaucaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 114708 - RNA, 1410 nt, Artificial Sequence
  derived and/or modified sequence opt2 from neuraminidase__InfluenzaA__AFV53307
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 114709 - RNA, 1410 nt, Artificial Sequence
  derived and/or modified sequence opt2 from neuraminidase__InfluenzaA__AFV53317
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcuccccccaccgcacccuccucaugaacgagcucggcguccccuuccaccucggcaccaagcaggucugcgccgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucggcccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 114710 - RNA, 1410 nt, Artificial Sequence
  derived and/or modified sequence opt2 from neuraminidase__InfluenzaA__AFV53328
augaaccccaaccagaagaucaucaccaucggcuccgucucccucaccaucgccaccgucugcuuccucaugcacaucgccauccucgccaccaccgucacccuccacuucaagcagcacgagugcgacucccccgccuccaaccaggccaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcaucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 114711 - RNA, 1410 nt, Artificial Sequence
  derived and/or modified sequence opt2 from neuraminidase__InfluenzaA__AFV53339
augaaccccaaccagaagaucaucaccaucggcuccgccucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacauguccccccucuccggcuccgcccagcacgucgaggagugcuccugcuacccccgcuaccccgacguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagaagggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaaccucaugcccaucuga

SEQ ID NO: 114712 - RNA, 1410 nt, Artificial Sequence; identical to SEQ ID NO: 108250
  derived and/or modified sequence opt2 from neuraminidase__InfluenzaA__AFX96367

SEQ ID NO: 114713 - RNA, 1410 nt, Artificial Sequence; identical to SEQ ID NO: 108250
  derived and/or modified sequence opt2 from neuraminidase__InfluenzaA__AFX96386

SEQ ID NO: 114714 - RNA, 1410 nt, Artificial Sequence; identical to SEQ ID NO: 108604
  derived and/or modified sequence opt2 from neuraminidase__InfluenzaA__AFX96401

SEQ ID NO: 114715 - RNA, 1410 nt, Artificial Sequence; identical to SEQ ID NO: 108604
  derived and/or modified sequence opt2 from neuraminidase__InfluenzaA__AFX96411

SEQ ID NO: 114716 - RNA, 1410 nt, Artificial Sequence; identical to SEQ ID NO: 108604
  derived and/or modified sequence opt2 from neuraminidase__InfluenzaA__AFX96421

SEQ ID NO: 114717 - RNA, 1410 nt, Artificial Sequence; identical to SEQ ID NO: 108604
  derived and/or modified sequence opt2 from neuraminidase__InfluenzaA__AFX96431

SEQ ID NO: 114718 - RNA, 1410 nt, Artificial Sequence; identical to SEQ ID NO: 108604
  derived and/or modified sequence opt2 from neuraminidase__InfluenzaA__AFX96441

SEQ ID NO: 114719 - RNA, 1410 nt, Artificial Sequence; identical to SEQ ID NO: 108604
  derived and/or modified sequence opt2 from neuraminidase__InfluenzaA__AFX96451

SEQ ID NO: 114720 - RNA, 1410 nt, Artificial Sequence; identical to SEQ ID NO: 108604
  derived and/or modified sequence opt2 from neuraminidase__InfluenzaA__AFX96461

SEQ ID NO: 114721 - RNA, 1410 nt, Artificial Sequence; identical to SEQ ID NO: 108250
  derived and/or modified sequence opt2 from neuraminidase__InfluenzaA__AFX96471

SEQ ID NO: 114722 - RNA, 1410 nt, Artificial Sequence; identical to SEQ ID NO: 108250
  derived and/or modified sequence opt2 from neuraminidase__InfluenzaA__AFX96481

SEQ ID NO: 114723 - RNA, 1410 nt, Artificial Sequence; identical to SEQ ID NO: 108250
  derived and/or modified sequence opt2 from neuraminidase__InfluenzaA__AFX96491

SEQ ID NO: 114724 - RNA, 1410 nt, Artificial Sequence; identical to SEQ ID NO: 108250
  derived and/or modified sequence opt2 from neuraminidase__InfluenzaA__AFX96501

SEQ ID NO: 114725 - RNA, 1410 nt, Artificial Sequence; identical to SEQ ID NO: 108250
  derived and/or modified sequence opt2 from neuraminidase__InfluenzaA__AFX96511

SEQ ID NO: 114726 - RNA, 1410 nt, Artificial Sequence
  derived and/or modified sequence opt2 from neuraminidase__InfluenzaA__AFX96521
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgcccgccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114727 - RNA, 1410 nt, Artificial Sequence; identical to SEQ ID NO: 108250
  derived and/or modified sequence opt2 from neuraminidase__InfluenzaA__AFX96531

SEQ ID NO: 114728 - RNA, 1410 nt, Artificial Sequence; identical to SEQ ID NO: 108250
  derived and/or modified sequence opt2 from neuraminidase__InfluenzaA__AFX96541

SEQ ID NO: 114729 - RNA, 1410 nt, Artificial Sequence; identical to SEQ ID NO: 108250
  derived and/or modified sequence opt2 from neuraminidase__InfluenzaA__AFX96551

SEQ ID NO: 114730 - RNA, 1410 nt, Artificial Sequence; identical to SEQ ID NO: 112774
  derived and/or modified sequence opt2 from neuraminidase__InfluenzaA__AFX96561

SEQ ID NO: 114731 - RNA, 1410 nt, Artificial Sequence; identical to SEQ ID NO: 108250
  derived and/or modified sequence opt2 from neuraminidase__InfluenzaA__AFX96571

SEQ ID NO: 114732 - RNA, 1410 nt, Artificial Sequence; identical to SEQ ID NO: 108250
  derived and/or modified sequence opt2 from neuraminidase__InfluenzaA__AFX96581

SEQ ID NO: 114733 - RNA, 1410 nt, Artificial Sequence; identical to SEQ ID NO: 108250
  derived and/or modified sequence opt2 from neuraminidase__InfluenzaA__AFX96591

SEQ ID NO: 114734 - RNA, 1410 nt, Artificial Sequence; identical to SEQ ID NO: 108250
  derived and/or modified sequence opt2 from neuraminidase__InfluenzaA__AFX96601

SEQ ID NO: 114735 - RNA, 1410 nt, Artificial Sequence; identical to SEQ ID NO: 108250
  derived and/or modified sequence opt2 from neuraminidase__InfluenzaA__AFX96611

SEQ ID NO: 114736 - RNA, 1410 nt, Artificial Sequence; identical to SEQ ID NO: 108250
  derived and/or modified sequence opt2 from neuraminidase__InfluenzaA__AFX96621

SEQ ID NO: 114737 - RNA, 1410 nt, Artificial Sequence; identical to SEQ ID NO: 108250
  derived and/or modified sequence opt2 from neuraminidase__InfluenzaA__AFX96631

SEQ ID NO: 114738 - RNA, 1410 nt, Artificial Sequence
  derived and/or modified sequence opt2 from neuraminidase__InfluenzaA__AFX96641
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacuccaaguucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114739 - RNA, 1410 nt, Artificial Sequence; identical to SEQ ID NO: 108250
  derived and/or modified sequence opt2 from neuraminidase__InfluenzaA__AFX96651

SEQ ID NO: 114740 - RNA, 1410 nt, Artificial Sequence; identical to SEQ ID NO: 108250
  derived and/or modified sequence opt2 from neuraminidase__InfluenzaA__AFX96661

SEQ ID NO: 114741 - RNA, 1410 nt, Artificial Sequence; identical to SEQ ID NO: 108250
  derived and/or modified sequence opt2 from neuraminidase__InfluenzaA__AFX96671

SEQ ID NO: 114742 - RNA, 1410 nt, Artificial Sequence; identical to SEQ ID NO: 108250
  derived and/or modified sequence opt2 from neuraminidase__InfluenzaA__AFX96681

SEQ ID NO: 114743 - RNA, 1410 nt, Artificial Sequence; identical to SEQ ID NO: 108250
  derived and/or modified sequence opt2 from neuraminidase__InfluenzaA__AFX96691

SEQ ID NO: 114744 - RNA, 1410 nt, Artificial Sequence
  derived and/or modified sequence opt2 from neuraminidase__InfluenzaA__AFX96701
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuucaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 114745 - RNA, 1410 nt, Artificial Sequence; identical to SEQ ID NO: 108250
  derived and/or modified sequence opt2 from neuraminidase__InfluenzaA__AFX96711

SEQ ID NO: 114746 - RNA, 1410 nt, Artificial Sequence
  derived and/or modified sequence opt2 from neuraminidase__InfluenzaA__AFX96721
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 114747 - RNA, 1410 nt, Artificial Sequence; identical to SEQ ID NO: 114746
  derived and/or modified sequence opt2 from neuraminidase__InfluenzaA__AFX96731

SEQ ID NO: 114748 - RNA, 1410 nt, Artificial Sequence; identical to SEQ ID NO: 108250
  derived and/or modified sequence opt2 from neuraminidase__InfluenzaA__AFX96741

SEQ ID NO: 114749 - RNA, 1410 nt, Artificial Sequence; identical to SEQ ID NO: 108250
  derived and/or modified sequence opt2 from neuraminidase__InfluenzaA__AFX96751

SEQ ID NO: 114750 - RNA, 1410 nt, Artificial Sequence; identical to SEQ ID NO: 109268
  derived and/or modified sequence opt2 from neuraminidase__InfluenzaA__AFX96761

SEQ ID NO: 114751 - RNA, 1410 nt, Artificial Sequence; identical to SEQ ID NO: 108250
  derived and/or modified sequence opt2 from neuraminidase__InfluenzaA__AFX96771

SEQ ID NO: 114752 - RNA, 1410 nt, Artificial Sequence
  derived and/or modified sequence opt2 from neuraminidase__InfluenzaA__AFX96791
augaaccccaaccagaagaucaucaccaucggcuccgucugcaugaccaucggcauggccaaccucauccuccaggucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcaucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114753 - RNA, 1410 nt, Artificial Sequence; identical to SEQ ID NO: 114752
  derived and/or modified sequence opt2 from neuraminidase__InfluenzaA__AFX96801

SEQ ID NO: 114754 - RNA, 1410 nt, Artificial Sequence
  derived and/or modified sequence opt2 from neuraminidase__InfluenzaA__AFX96811
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccguccgccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114755 - RNA, 1410 nt, Artificial Sequence; identical to SEQ ID NO: 108250
  derived and/or modified sequence opt2 from neuraminidase__InfluenzaA__AFX96821

SEQ ID NO: 114756 - RNA, 1410 nt, Artificial Sequence; identical to SEQ ID NO: 114752
  derived and/or modified sequence opt2 from neuraminidase__InfluenzaA__AFX96831

SEQ ID NO: 114757 - RNA, 1410 nt, Artificial Sequence
  derived and/or modified sequence opt2 from neuraminidase__InfluenzaA__AFX96841
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccguccgccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114758 - RNA, 1410 nt, Artificial Sequence; identical to SEQ ID NO: 108250
  derived and/or modified sequence opt2 from neuraminidase__InfluenzaA__AFX96859

SEQ ID NO: 114759 - RNA, 1410 nt, Artificial Sequence; identical to SEQ ID NO: 108250
  derived and/or modified sequence opt2 from neuraminidase__InfluenzaA__AFX96907

SEQ ID NO: 114760 - RNA, 1410 nt, Artificial Sequence; identical to SEQ ID NO: 108250
  derived and/or modified sequence opt2 from neuraminidase__InfluenzaA__AFX96917

SEQ ID NO: 114761 - RNA, 1410 nt, Artificial Sequence; identical to SEQ ID NO: 108250
  derived and/or modified sequence opt2 from neuraminidase__InfluenzaA__AFX96927

SEQ ID NO: 114762 - RNA, 1410 nt, Artificial Sequence
  derived and/or modified sequence opt2 from neuraminidase__InfluenzaA__AFX96937
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccuccaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114763 - RNA, 1410 nt, Artificial Sequence; identical to SEQ ID NO: 108240
  derived and/or modified sequence opt2 from neuraminidase__InfluenzaA__AFY23991

SEQ ID NO: 114764 - RNA, 1410 nt, Artificial Sequence; identical to SEQ ID NO: 108250
  derived and/or modified sequence opt2 from neuraminidase__InfluenzaA__AFY24001

SEQ ID NO: 114765 - RNA, 1410 nt, Artificial Sequence; identical to SEQ ID NO: 108250
  derived and/or modified sequence opt2 from neuraminidase__InfluenzaA__AFY24022

SEQ ID NO: 114766 - RNA, 1410 nt, Artificial Sequence; identical to SEQ ID NO: 108250
  derived and/or modified sequence opt2 from neuraminidase__InfluenzaA__AFY24043

SEQ ID NO: 114767 - RNA, 1410 nt, Artificial Sequence
  derived and/or modified sequence opt2 from neuraminidase__InfluenzaA__AFY24153
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaccgacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114768 - RNA, 1410 nt, Artificial Sequence
  derived and/or modified sequence opt2 from neuraminidase__InfluenzaA__AFY24208
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagcgccuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 114769 - RNA, 1410 nt, Artificial Sequence; identical to SEQ ID NO: 107441
  derived and/or modified sequence opt2 from neuraminidase__InfluenzaA__AFY24219

SEQ ID NO: 114770 - RNA, 1410 nt, Artificial Sequence
  derived and/or modified sequence opt2 from neuraminidase__InfluenzaA__AGB12978
augaaccccaaccagcgcaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgcccgccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114771 - RNA, 1410 nt, Artificial Sequence; identical to SEQ ID NO: 111769
  derived and/or modified sequence opt2 from neuraminidase__InfluenzaA__AGB12989

SEQ ID NO: 114772 - RNA, 1410 nt, Artificial Sequence; identical to SEQ ID NO: 112221
  derived and/or modified sequence opt2 from neuraminidase__InfluenzaA__AGB13009

SEQ ID NO: 114773 - RNA, 1410 nt, Artificial Sequence; identical to SEQ ID NO: 112221
  derived and/or modified sequence opt2 from neuraminidase__InfluenzaA__AGB13019

SEQ ID NO: 114774 - RNA, 1410 nt, Artificial Sequence; identical to SEQ ID NO: 112221
  derived and/or modified sequence opt2 from neuraminidase__InfluenzaA__AGB13029

SEQ ID NO: 114775 - RNA, 1410 nt, Artificial Sequence; identical to SEQ ID NO: 112470
  derived and/or modified sequence opt2 from neuraminidase__InfluenzaA__AGB13039

SEQ ID NO: 114776 - RNA, 1410 nt, Artificial Sequence; identical to SEQ ID NO: 112221
  derived and/or modified sequence opt2 from neuraminidase__InfluenzaA__AGB13051

SEQ ID NO: 114777 - RNA, 1410 nt, Artificial Sequence
  derived and/or modified sequence opt2 from neuraminidase__InfluenzaA__AGB13069
augaaccccaaccagaagaucaucaccaucggcuccaucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccuggaucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114778 - RNA, 1410 nt, Artificial Sequence
  derived and/or modified sequence opt2 from neuraminidase__InfluenzaA__AGB13074
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114779 - RNA, 1410 nt, Artificial Sequence
  derived and/or modified sequence opt2 from neuraminidase__InfluenzaA__AGB13115
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucguccuccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcgcggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114780 - RNA, 1410 nt, Artificial Sequence; identical to SEQ ID NO: 112221
  derived and/or modified sequence opt2 from neuraminidase__InfluenzaA__AGB13133

SEQ ID NO: 114781 - RNA, 1410 nt, Artificial Sequence; identical to SEQ ID NO: 111769
  derived and/or modified sequence opt2 from neuraminidase__InfluenzaA__AGB13152

SEQ ID NO: 114782 - RNA, 1410 nt, Artificial Sequence; identical to SEQ ID NO: 111769
  derived and/or modified sequence opt2 from neuraminidase__InfluenzaA__AGB13162

SEQ ID NO: 114783 - RNA, 1410 nt, Artificial Sequence; identical to SEQ ID NO: 112592
  derived and/or modified sequence opt2 from neuraminidase__InfluenzaA__AGB13173

SEQ ID NO: 114784 - RNA, 1410 nt, Artificial Sequence
  derived and/or modified sequence opt2 from neuraminidase__InfluenzaA__AGB13183
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccaggacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114785 - RNA, 1410 nt, Artificial Sequence; identical to SEQ ID NO: 112221
  derived and/or modified sequence opt2 from neuraminidase__InfluenzaA__AGB13193

SEQ ID NO: 114786 - RNA, 1410 nt, Artificial Sequence; identical to SEQ ID NO: 112288
  derived and/or modified sequence opt2 from neuraminidase__InfluenzaA__AGB13203

SEQ ID NO: 114787 - RNA, 1410 nt, Artificial Sequence; identical to SEQ ID NO: 112221
  derived and/or modified sequence opt2 from neuraminidase__InfluenzaA__AGB13213

SEQ ID NO: 114788 - RNA, 1410 nt, Artificial Sequence; identical to SEQ ID NO: 112221
  derived and/or modified sequence opt2 from neuraminidase__InfluenzaA__AGB13223

SEQ ID NO: 114789 - RNA, 1410 nt, Artificial Sequence; identical to SEQ ID NO: 112221
  derived and/or modified sequence opt2 from neuraminidase__InfluenzaA__AGB13233

SEQ ID NO: 114790 - RNA, 1410 nt, Artificial Sequence
  derived and/or modified sequence opt2 from neuraminidase__InfluenzaA__AGB13243
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagcgcggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114791 - RNA, 1410 nt, Artificial Sequence; identical to SEQ ID NO: 112288
  derived and/or modified sequence opt2 from neuraminidase__InfluenzaA__AGB13253

SEQ ID NO: 114792 - RNA, 1410 nt, Artificial Sequence
  derived and/or modified sequence opt2 from neuraminidase__InfluenzaA__AGB13263
augaaccccaaccagaagaucaucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccgucgacaaguga

SEQ ID NO: 114793 - RNA, 1410 nt, Artificial Sequence; identical to SEQ ID NO: 112221
  derived and/or modified sequence opt2 from neuraminidase__InfluenzaA__AGB13273

SEQ ID NO: 114794 - RNA, 1410 nt, Artificial Sequence
  derived and/or modified sequence opt2 from neuraminidase__InfluenzaA__AGB13283
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgccgcggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114795 - RNA, 1410 nt, Artificial Sequence; identical to SEQ ID NO: 112221
  derived and/or modified sequence opt2 from neuraminidase__InfluenzaA__AGB13293

SEQ ID NO: 114796 - RNA, 1410 nt, Artificial Sequence; identical to SEQ ID NO: 112221
  derived and/or modified sequence opt2 from neuraminidase__InfluenzaA__AGB13303

SEQ ID NO: 114797 - RNA, 1410 nt, Artificial Sequence
  derived and/or modified sequence opt2 from neuraminidase__InfluenzaA__AGB13313
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgccaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114798 - RNA, 1410 nt, Artificial Sequence; identical to SEQ ID NO: 112221
  derived and/or modified sequence opt2 from neuraminidase__InfluenzaA__AGB13323

SEQ ID NO: 114799 - RNA, 1410 nt, Artificial Sequence
  derived and/or modified sequence opt2 from neuraminidase__InfluenzaA__AGB13333
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgccgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114800 - RNA, 1410 nt, Artificial Sequence; identical to SEQ ID NO: 112221
  derived and/or modified sequence opt2 from neuraminidase__InfluenzaA__AGB13343

SEQ ID NO: 114801 - RNA, 1410 nt, Artificial Sequence; identical to SEQ ID NO: 112470
  derived and/or modified sequence opt2 from neuraminidase__InfluenzaA__AGB13353

SEQ ID NO: 114802 - RNA, 1410 nt, Artificial Sequence
  derived and/or modified sequence opt2 from neuraminidase__InfluenzaA__AGB13363
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugcuccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114803 - RNA, 1410 nt, Artificial Sequence
  derived and/or modified sequence opt2 from neuraminidase__InfluenzaA__AGB13383
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcuccggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114804 - RNA, 1410 nt, Artificial Sequence; identical to SEQ ID NO: 111769
  derived and/or modified sequence opt2 from neuraminidase__InfluenzaA__AGB13393

SEQ ID NO: 114805 - RNA, 1410 nt, Artificial Sequence; identical to SEQ ID NO: 112469
  derived and/or modified sequence opt2 from neuraminidase__InfluenzaA__AGB13403

SEQ ID NO: 114806 - RNA, 1410 nt, Artificial Sequence; identical to SEQ ID NO: 111769
  derived and/or modified sequence opt2 from neuraminidase__InfluenzaA__AGB13413

SEQ ID NO: 114807 - RNA, 1410 nt, Artificial Sequence; identical to SEQ ID NO: 111769
  derived and/or modified sequence opt2 from neuraminidase__InfluenzaA__AGB13423

SEQ ID NO: 114808 - RNA, 1410 nt, Artificial Sequence; identical to SEQ ID NO: 112469
  derived and/or modified sequence opt2 from neuraminidase__InfluenzaA__AGB13433

SEQ ID NO: 114809 - RNA, 1410 nt, Artificial Sequence; identical to SEQ ID NO: 112469
  derived and/or modified sequence opt2 from neuraminidase__InfluenzaA__AGB13443

SEQ ID NO: 114810 - RNA, 1410 nt, Artificial Sequence
  derived and/or modified sequence opt2 from neuraminidase__InfluenzaA__AGB13453
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccuucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114811 - RNA, 1410 nt, Artificial Sequence; identical to SEQ ID NO: 111769
  derived and/or modified sequence opt2 from neuraminidase__InfluenzaA__AGB13463

SEQ ID NO: 114812 - RNA, 1410 nt, Artificial Sequence; identical to SEQ ID NO: 112221
  derived and/or modified sequence opt2 from neuraminidase__InfluenzaA__AGB13473

SEQ ID NO: 114813 - RNA, 1410 nt, Artificial Sequence
  derived and/or modified sequence opt2 from neuraminidase__InfluenzaA__AGB13483
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccagcccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114814 - RNA, 1410 nt, Artificial Sequence; identical to SEQ ID NO: 112506
  derived and/or modified sequence opt2 from neuraminidase__InfluenzaA__AGB13493

SEQ ID NO: 114815 - RNA, 1410 nt, Artificial Sequence; identical to SEQ ID NO: 112298
  derived and/or modified sequence opt2 from neuraminidase__InfluenzaA__AGB13503

SEQ ID NO: 114816 - RNA, 1410 nt, Artificial Sequence; identical to SEQ ID NO: 109712
  derived and/or modified sequence opt2 from neuraminidase__InfluenzaA__AGB13513

SEQ ID NO: 114817 - RNA, 1410 nt, Artificial Sequence; identical to SEQ ID NO: 112504
  derived and/or modified sequence opt2 from neuraminidase__InfluenzaA__AGB13523

SEQ ID NO: 114818 - RNA, 1410 nt, Artificial Sequence; identical to SEQ ID NO: 112504
  derived and/or modified sequence opt2 from neuraminidase__InfluenzaA__AGB13533

SEQ ID NO: 114819 - RNA, 1410 nt, Artificial Sequence; identical to SEQ ID NO: 112221
  derived and/or modified sequence opt2 from neuraminidase__InfluenzaA__AGB13543

SEQ ID NO: 114820 - RNA, 1410 nt, Artificial Sequence; identical to SEQ ID NO: 112221
  derived and/or modified sequence opt2 from neuraminidase__InfluenzaA__AGB13553

SEQ ID NO: 114821 - RNA, 1410 nt, Artificial Sequence
  derived and/or modified sequence opt2 from neuraminidase__InfluenzaA__AGB13563
augaaccccaaccagaagaucaucaccaucggcuccgucugcaugaccaucggcgucgccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaaccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaagaacaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114822 - RNA, 1410 nt, Artificial Sequence; identical to SEQ ID NO: 112221
  derived and/or modified sequence opt2 from neuraminidase__InfluenzaA__AGB13573

SEQ ID NO: 114823 - RNA, 1410 nt, Artificial Sequence
  derived and/or modified sequence opt2 from neuraminidase__InfluenzaA__AGB13583
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucggcuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114824 - RNA, 1410 nt, Artificial Sequence; identical to SEQ ID NO: 112221
  derived and/or modified sequence opt2 from neuraminidase__InfluenzaA__AGB13593

SEQ ID NO: 114825 - RNA, 1410 nt, Artificial Sequence; identical to SEQ ID NO: 112221
  derived and/or modified sequence opt2 from neuraminidase__InfluenzaA__AGB13603

SEQ ID NO: 114826 - RNA, 1410 nt, Artificial Sequence; identical to SEQ ID NO: 112221
  derived and/or modified sequence opt2 from neuraminidase__InfluenzaA__AGB13613

SEQ ID NO: 114827 - RNA, 1410 nt, Artificial Sequence; identical to SEQ ID NO: 112221
  derived and/or modified sequence opt2 from neuraminidase__InfluenzaA__AGB13623

SEQ ID NO: 114828 - RNA, 1410 nt, Artificial Sequence
  derived and/or modified sequence opt2 from neuraminidase__InfluenzaA__AGB13633
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 114829 - RNA, 1410 nt, Artificial Sequence
  derived and/or modified sequence opt2 from neuraminidase__InfluenzaA__AGB13643
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacggcauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccgucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114830 - RNA, 1410 nt, Artificial Sequence
  derived and/or modified sequence opt2 from neuraminidase__InfluenzaA__AGB13653
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccgucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114831 - RNA, 1410 nt, Artificial Sequence; identical to SEQ ID NO: 111769
  derived and/or modified sequence opt2 from neuraminidase__InfluenzaA__AGB13663

SEQ ID NO: 114832 - RNA, 1410 nt, Artificial Sequence; identical to SEQ ID NO: 111769
  derived and/or modified sequence opt2 from neuraminidase__InfluenzaA__AGB13724

SEQ ID NO: 114833 - RNA, 1410 nt, Artificial Sequence; identical to SEQ ID NO: 112221
  derived and/or modified sequence opt2 from neuraminidase__InfluenzaA__AGB13734

SEQ ID NO: 114834 - RNA, 1410 nt, Artificial Sequence; identical to SEQ ID NO: 108726
  derived and/or modified sequence opt2 from neuraminidase__InfluenzaA__AGB51359

SEQ ID NO: 114835 - RNA, 1410 nt, Artificial Sequence
  derived and/or modified sequence opt2 from neuraminidase__InfluenzaA__AGB97270
augaaccccaaccagaagaucaucaccaucggcuccgucugcaugaccaucggcauggccaaccucauccuccagaucggcaacaucaucuccaucuggaucucccacuccauccagcuccgcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccauggccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114836 - RNA, 1410 nt, Artificial Sequence
  derived and/or modified sequence opt2 from neuraminidase__InfluenzaA__AGB97274
augaaccccaaccagaagaucaucaccaucggcuccgucugcaugaccaucggcauggccaaccucauccuccagaucggcaacaucaucuccaucuggaucucccacuccauccagcuccgcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114837 - RNA, 1410 nt, Artificial Sequence; identical to SEQ ID NO: 113658
  derived and/or modified sequence opt2 from neuraminidase__InfluenzaA__AGB97289

SEQ ID NO: 114838 - RNA, 1410 nt, Artificial Sequence
  derived and/or modified sequence opt2 from neuraminidase__InfluenzaA__AGE15475
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcucccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucuccaucgacaaguga

SEQ ID NO: 114839 - RNA, 1410 nt, Artificial Sequence
  derived and/or modified sequence opt2 from neuraminidase__InfluenzaA__AGE15476
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcucccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114840 - RNA, 1410 nt, Artificial Sequence; identical to SEQ ID NO: 114670
  derived and/or modified sequence opt2 from neuraminidase__InfluenzaA__AGE15477

SEQ ID NO: 114841 - RNA, 1410 nt, Artificial Sequence
  derived and/or modified sequence opt2 from neuraminidase__InfluenzaA__AGE15478
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcucccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaaguccgacaccgucggcugguccuggcccgacggcgccgagcuccccuucaccaucgacaaguga

SEQ ID NO: 114842 - RNA, 1410 nt, Artificial Sequence
  derived and/or modified sequence opt2 from neuraminidase__InfluenzaA__AGE15479
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcucccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccaucgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114843 - RNA, 1410 nt, Artificial Sequence; identical to SEQ ID NO: 114670
  derived and/or modified sequence opt2 from neuraminidase__InfluenzaA__AGE15480

SEQ ID NO: 114844 - RNA, 1410 nt, Artificial Sequence; identical to SEQ ID NO: 109712
  derived and/or modified sequence opt2 from neuraminidase__InfluenzaA__AGE89270

SEQ ID NO: 114845 - RNA, 1410 nt, Artificial Sequence; identical to SEQ ID NO: 109712
  derived and/or modified sequence opt2 from neuraminidase__InfluenzaA__AGE89280

SEQ ID NO: 114846 - RNA, 1410 nt, Artificial Sequence
  derived and/or modified sequence opt2 from neuraminidase__InfluenzaA__AGE89290
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaucgucgucaugaccgacggcuccgccuccggcaaggccgacaccaagauccucuucgucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucaucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114847 - RNA, 1410 nt, Artificial Sequence; identical to SEQ ID NO: 111769
  derived and/or modified sequence opt2 from neuraminidase__InfluenzaA__AGE89301

SEQ ID NO: 114848 - RNA, 1410 nt, Artificial Sequence
  derived and/or modified sequence opt2 from neuraminidase__InfluenzaA__AGE89311
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggaagaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaagaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccauguccuucugcggcgucaacuccgacaccgucggcugguccuggcccgacggcgccgagcuccccuucaccaucgacaaguga

SEQ ID NO: 114849 - RNA, 1410 nt, Artificial Sequence; identical to SEQ ID NO: 113299
  derived and/or modified sequence opt2 from neuraminidase__InfluenzaA__AGE89321

SEQ ID NO: 114850 - RNA, 1410 nt, Artificial Sequence; identical to SEQ ID NO: 112655
  derived and/or modified sequence opt2 from neuraminidase__InfluenzaA__AGE89332

SEQ ID NO: 114851 - RNA, 1410 nt, Artificial Sequence; identical to SEQ ID NO: 111769
  derived and/or modified sequence opt2 from neuraminidase__InfluenzaA__AGE89343

SEQ ID NO: 114852 - RNA, 1410 nt, Artificial Sequence
  derived and/or modified sequence opt2 from neuraminidase__InfluenzaA__AGE89353
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaucaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114853 - RNA, 1410 nt, Artificial Sequence; identical to SEQ ID NO: 112506
  derived and/or modified sequence opt2 from neuraminidase__InfluenzaA__AGE89364

SEQ ID NO: 114854 - RNA, 1410 nt, Artificial Sequence; identical to SEQ ID NO: 113299
  derived and/or modified sequence opt2 from neuraminidase__InfluenzaA__AGE89374

SEQ ID NO: 114855 - RNA, 1410 nt, Artificial Sequence
  derived and/or modified sequence opt2 from neuraminidase__InfluenzaA__AGE89385
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114856 - RNA, 1410 nt, Artificial Sequence
  derived and/or modified sequence opt2 from neuraminidase__InfluenzaA__AGE89395
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114857 - RNA, 1410 nt, Artificial Sequence; identical to SEQ ID NO: 109712
  derived and/or modified sequence opt2 from neuraminidase__InfluenzaA__AGE89425

SEQ ID NO: 114858 - RNA, 1410 nt, Artificial Sequence; identical to SEQ ID NO: 111030
  derived and/or modified sequence opt2 from neuraminidase__InfluenzaA__AGE89722

SEQ ID NO: 114859 - RNA, 1410 nt, Artificial Sequence
  derived and/or modified sequence opt2 from neuraminidase__InfluenzaA__AGE89733
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114860 - RNA, 1410 nt, Artificial Sequence
  derived and/or modified sequence opt2 from neuraminidase__InfluenzaA__AGE89743
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaaggacaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114861 - RNA, 1410 nt, Artificial Sequence; identical to SEQ ID NO: 113299
  derived and/or modified sequence opt2 from neuraminidase__InfluenzaA__AGE89754

SEQ ID NO: 114862 - RNA, 1410 nt, Artificial Sequence; identical to SEQ ID NO: 113299
  derived and/or modified sequence opt2 from neuraminidase__InfluenzaA__AGE89765

SEQ ID NO: 114863 - RNA, 1410 nt, Artificial Sequence
  derived and/or modified sequence opt2 from neuraminidase__InfluenzaA__AGG13414
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacuccguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114864 - RNA, 1410 nt, Artificial Sequence; identical to SEQ ID NO: 113658
  derived and/or modified sequence opt2 from neuraminidase__InfluenzaA__AGG13426

SEQ ID NO: 114865 - RNA, 1410 nt, Artificial Sequence; identical to SEQ ID NO: 113658
  derived and/or modified sequence opt2 from neuraminidase__InfluenzaA__AGG13438

SEQ ID NO: 114866 - RNA, 1410 nt, Artificial Sequence
  derived and/or modified sequence opt2 from neuraminidase__InfluenzaA__AGG13498
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114867 - RNA, 1410 nt, Artificial Sequence; identical to SEQ ID NO: 113658
  derived and/or modified sequence opt2 from neuraminidase__InfluenzaA__AGG13510

SEQ ID NO: 114868 - RNA, 1410 nt, Artificial Sequence; identical to SEQ ID NO: 114866
  derived and/or modified sequence opt2 from neuraminidase__InfluenzaA__AGG13522

SEQ ID NO: 114869 - RNA, 1410 nt, Artificial Sequence
  derived and/or modified sequence opt2 from neuraminidase__InfluenzaA__AGG13534
augaaccccaaccagaagaucaucaccaucggcuccgucucccucaccaucuccaccgucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114870 - RNA, 1410 nt, Artificial Sequence
  derived and/or modified sequence opt2 from neuraminidase__InfluenzaA__AGG13546
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114871 - RNA, 1410 nt, Artificial Sequence; identical to SEQ ID NO: 113658
  derived and/or modified sequence opt2 from neuraminidase__InfluenzaA__AGG13558

SEQ ID NO: 114872 - RNA, 1410 nt, Artificial Sequence; identical to SEQ ID NO: 113658
  derived and/or modified sequence opt2 from neuraminidase__InfluenzaA__AGG13570

SEQ ID NO: 114873 - RNA, 1410 nt, Artificial Sequence
  derived and/or modified sequence opt2 from neuraminidase__InfluenzaA__AGG13582
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgaggacaagaacgccaccgccuccuucaucuacaacggccgccucgucgacuccgucgucuccugguccaaggagacccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114874 - RNA, 1410 nt, Artificial Sequence; identical to SEQ ID NO: 113658
  derived and/or modified sequence opt2 from neuraminidase__InfluenzaA__AGG13606

SEQ ID NO: 114875 - RNA, 1410 nt, Artificial Sequence
  derived and/or modified sequence opt2 from neuraminidase__InfluenzaA__AGG13618
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacggcuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccagaucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114876 - RNA, 1410 nt, Artificial Sequence
  derived and/or modified sequence opt2 from neuraminidase__InfluenzaA__AGG13630
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgaggacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114877 - RNA, 1410 nt, Artificial Sequence; identical to SEQ ID NO: 113658
  derived and/or modified sequence opt2 from neuraminidase__InfluenzaA__AGG13642

SEQ ID NO: 114878 - RNA, 1410 nt, Artificial Sequence
  derived and/or modified sequence opt2 from neuraminidase__InfluenzaA__AGG13654
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcgccgucgucaugaccgacggcuccgccuccggcaaggccgacaccaagauccucuucaucgaggagggcaagaucguccagaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaucgagguccucuggaccuccaacuccaucgucgucuucugcggcaccuccggcaccuacggcaccggcuccuggcccgacggcgccgaccucaaccucaugcccaucuga

SEQ ID NO: 114879 - RNA, 1410 nt, Artificial Sequence; identical to SEQ ID NO: 114869
  derived and/or modified sequence opt2 from neuraminidase__InfluenzaA__AGG13666

SEQ ID NO: 114880 - RNA, 1410 nt, Artificial Sequence
  derived and/or modified sequence opt2 from neuraminidase__InfluenzaA__AGG13678
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgccccccucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucggccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccgccggcaccuacggcaccggcuccuggcccgacggcgccgaccucaaccucaugcccaucuga

SEQ ID NO: 114881 - RNA, 1410 nt, Artificial Sequence; identical to SEQ ID NO: 113658
  derived and/or modified sequence opt2 from neuraminidase__InfluenzaA__AGG13690

SEQ ID NO: 114882 - RNA, 1410 nt, Artificial Sequence
  derived and/or modified sequence opt2 from neuraminidase__InfluenzaA__AGG13702
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcaacgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114883 - RNA, 1410 nt, Artificial Sequence; identical to SEQ ID NO: 114866
  derived and/or modified sequence opt2 from neuraminidase__InfluenzaA__AGG13714

SEQ ID NO: 114884 - RNA, 1410 nt, Artificial Sequence; identical to SEQ ID NO: 113658
  derived and/or modified sequence opt2 from neuraminidase__InfluenzaA__AGG13726

SEQ ID NO: 114885 - RNA, 1410 nt, Artificial Sequence; identical to SEQ ID NO: 113658
  derived and/or modified sequence opt2 from neuraminidase__InfluenzaA__AGG13738

SEQ ID NO: 114886 - RNA, 1410 nt, Artificial Sequence; identical to SEQ ID NO: 113658
  derived and/or modified sequence opt2 from neuraminidase__InfluenzaA__AGG13750

SEQ ID NO: 114887 - RNA, 1410 nt, Artificial Sequence
  derived and/or modified sequence opt2 from neuraminidase__InfluenzaA__AGG13762
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114888 - RNA, 1410 nt, Artificial Sequence
  derived and/or modified sequence opt2 from neuraminidase__InfluenzaA__AGG13774
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaccaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114889 - RNA, 1410 nt, Artificial Sequence
  derived and/or modified sequence opt2 from neuraminidase__InfluenzaA__AGG13786
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccuccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114890 - RNA, 1410 nt, Artificial Sequence; identical to SEQ ID NO: 114866
  derived and/or modified sequence opt2 from neuraminidase__InfluenzaA__AGG13798

SEQ ID NO: 114891 - RNA, 1410 nt, Artificial Sequence
  derived and/or modified sequence opt2 from neuraminidase__InfluenzaA__AGG13810
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucggccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114892 - RNA, 1410 nt, Artificial Sequence; identical to SEQ ID NO: 114866
  derived and/or modified sequence opt2 from neuraminidase__InfluenzaA__AGG13822

SEQ ID NO: 114893 - RNA, 1410 nt, Artificial Sequence; identical to SEQ ID NO: 114866
  derived and/or modified sequence opt2 from neuraminidase__InfluenzaA__AGG13834

SEQ ID NO: 114894 - RNA, 1410 nt, Artificial Sequence; identical to SEQ ID NO: 114887
  derived and/or modified sequence opt2 from neuraminidase__InfluenzaA__AGG13846

SEQ ID NO: 114895 - RNA, 1410 nt, Artificial Sequence; identical to SEQ ID NO: 113658
  derived and/or modified sequence opt2 from neuraminidase__InfluenzaA__AGG13858

SEQ ID NO: 114896 - RNA, 1410 nt, Artificial Sequence
  derived and/or modified sequence opt2 from neuraminidase__InfluenzaA__AGG13870
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgaccgcugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaccuccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114897 - RNA, 1410 nt, Artificial Sequence
  derived and/or modified sequence opt2 from neuraminidase__InfluenzaA__AGG13894
augaaccccaaccagaagaucaucaccaucggcuccgucucccucaccaucuccaccgucugcuucuucaugcagaucgccauccucaucaccaccgucacccuccacuucaagcaguacgaguucaacuccccccccaacaaccaggucaugcucugcgagcccaccaucaucgagcgcaacgucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114898 - RNA, 1410 nt, Artificial Sequence; identical to SEQ ID NO: 114866
  derived and/or modified sequence opt2 from neuraminidase__InfluenzaA__AGG13906

SEQ ID NO: 114899 - RNA, 1410 nt, Artificial Sequence
  derived and/or modified sequence opt2 from neuraminidase__InfluenzaA__AGG13930
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgaccgcuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114900 - RNA, 1410 nt, Artificial Sequence; identical to SEQ ID NO: 114876
  derived and/or modified sequence opt2 from neuraminidase__InfluenzaA__AGG13942

SEQ ID NO: 114901 - RNA, 1410 nt, Artificial Sequence
  derived and/or modified sequence opt2 from neuraminidase__InfluenzaA__AGG13965
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114902 - RNA, 1410 nt, Artificial Sequence; identical to SEQ ID NO: 114869
  derived and/or modified sequence opt2 from neuraminidase__InfluenzaA__AGG13976

SEQ ID NO: 114903 - RNA, 1410 nt, Artificial Sequence; identical to SEQ ID NO: 114869
  derived and/or modified sequence opt2 from neuraminidase__InfluenzaA__AGG13988

SEQ ID NO: 114904 - RNA, 1410 nt, Artificial Sequence; identical to SEQ ID NO: 114869
  derived and/or modified sequence opt2 from neuraminidase__InfluenzaA__AGG14000

SEQ ID NO: 114905 - RNA, 1410 nt, Artificial Sequence; identical to SEQ ID NO: 114869
  derived and/or modified sequence opt2 from neuraminidase__InfluenzaA__AGG14012

SEQ ID NO: 114906 - RNA, 1410 nt, Artificial Sequence; identical to SEQ ID NO: 114887
  derived and/or modified sequence opt2 from neuraminidase__InfluenzaA__AGG14024

SEQ ID NO: 114907 - RNA, 1410 nt, Artificial Sequence
  derived and/or modified sequence opt2 from neuraminidase__InfluenzaA__AGG14036
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacaugugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 114908 - RNA, 1410 nt, Artificial Sequence; identical to SEQ ID NO: 114887
  derived and/or modified sequence opt2 from neuraminidase__InfluenzaA__AGG14321

SEQ ID NO: 114909 - RNA, 1410 nt, Artificial Sequence; identical to SEQ ID NO: 113658
  derived and/or modified sequence opt2 from neuraminidase__InfluenzaA__AGG14333

SEQ ID NO: 114910 - RNA, 1410 nt, Artificial Sequence; identical to SEQ ID NO: 113299
  derived and/or modified sequence opt2 from neuraminidase__InfluenzaA__AGG84182

SEQ ID NO: 114911 - RNA, 1398 nt, Artificial Sequence
  derived and/or modified sequence opt2 from neuraminidase__InfluenzaA__AGJ51955
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaagguccucuggaccggcgacuccaucgucuccaugugcuccuccaccgaguuccucggccaguggaacuggcccgacggcgccaagaucgaguacuuccucuga

SEQ ID NO: 114912 - RNA, 1398 nt, Artificial Sequence
  derived and/or modified sequence opt2 from neuraminidase__InfluenzaA__AGJ72863
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgaggucauccgcggccgccccaaggaggacaaggucuggugggccggcaacuccaucgucuccaugugcuccuccaccgaguuccucggccaguggaacuggcccgacggcgccaagaucgaguacuuccucuga

SEQ ID NO: 114913 - RNA, 1410 nt, Artificial Sequence
  derived and/or modified sequence opt2 from neuraminidase__InfluenzaA__AGJ73328
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaacggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114914 - RNA, 1410 nt, Artificial Sequence; identical to SEQ ID NO: 111769
  derived and/or modified sequence opt2 from neuraminidase__InfluenzaA__AGJ73330

SEQ ID NO: 114915 - RNA, 1410 nt, Artificial Sequence
  derived and/or modified sequence opt2 from neuraminidase__InfluenzaA__AGJ73332
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccacaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114916 - RNA, 1410 nt, Artificial Sequence; identical to SEQ ID NO: 111769
  derived and/or modified sequence opt2 from neuraminidase__InfluenzaA__AGJ73334

SEQ ID NO: 114917 - RNA, 1410 nt, Artificial Sequence; identical to SEQ ID NO: 111769
  derived and/or modified sequence opt2 from neuraminidase__InfluenzaA__AGJ73336

SEQ ID NO: 114918 - RNA, 1410 nt, Artificial Sequence; identical to SEQ ID NO: 111769
  derived and/or modified sequence opt2 from neuraminidase__InfluenzaA__AGJ73338

SEQ ID NO: 114919 - RNA, 1410 nt, Artificial Sequence
  derived and/or modified sequence opt2 from neuraminidase__InfluenzaA__AGJ73340
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgccuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114920 - RNA, 1410 nt, Artificial Sequence
  derived and/or modified sequence opt2 from neuraminidase__InfluenzaA__AGJ73342
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 114921 - RNA, 1410 nt, Artificial Sequence; identical to SEQ ID NO: 112221
  derived and/or modified sequence opt2 from neuraminidase__InfluenzaA__AGJ73344

SEQ ID NO: 114922 - RNA, 1410 nt, Artificial Sequence
  derived and/or modified sequence opt2 from neuraminidase__InfluenzaA__AGJ73346
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaagugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 114923 - RNA, 1410 nt, Artificial Sequence
  derived and/or modified sequence opt2 from neuraminidase__InfluenzaA__AGJ73348
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucaucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114924 - RNA, 1410 nt, Artificial Sequence
  derived and/or modified sequence opt2 from neuraminidase__InfluenzaA__AGJ73350
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacgagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgucaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114925 - RNA, 1410 nt, Artificial Sequence
  derived and/or modified sequence opt2 from neuraminidase__InfluenzaA__AGJ73352
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacuccccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114926 - RNA, 1410 nt, Artificial Sequence; identical to SEQ ID NO: 112221
  derived and/or modified sequence opt2 from neuraminidase__InfluenzaA__AGJ73354

SEQ ID NO: 114927 - RNA, 1410 nt, Artificial Sequence
  derived and/or modified sequence opt2 from neuraminidase__InfluenzaA__AGJ73356
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacuucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114928 - RNA, 1410 nt, Artificial Sequence; identical to SEQ ID NO: 112221
  derived and/or modified sequence opt2 from neuraminidase__InfluenzaA__AGJ73358

SEQ ID NO: 114929 - RNA, 1410 nt, Artificial Sequence; identical to SEQ ID NO: 112221
  derived and/or modified sequence opt2 from neuraminidase__InfluenzaA__AGJ73360

SEQ ID NO: 114930 - RNA, 1410 nt, Artificial Sequence
  derived and/or modified sequence opt2 from neuraminidase__InfluenzaA__AGJ73362
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgacggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114931 - RNA, 1410 nt, Artificial Sequence; identical to SEQ ID NO: 113344
  derived and/or modified sequence opt2 from neuraminidase__InfluenzaA__AGJ73364

SEQ ID NO: 114932 - RNA, 1410 nt, Artificial Sequence; identical to SEQ ID NO: 112221
  derived and/or modified sequence opt2 from neuraminidase__InfluenzaA__AGJ73366

SEQ ID NO: 114933 - RNA, 1410 nt, Artificial Sequence; identical to SEQ ID NO: 111769
  derived and/or modified sequence opt2 from neuraminidase__InfluenzaA__AGJ73370

SEQ ID NO: 114934 - RNA, 1410 nt, Artificial Sequence
  derived and/or modified sequence opt2 from neuraminidase__InfluenzaA__AGJ73372
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccacaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114935 - RNA, 1410 nt, Artificial Sequence; identical to SEQ ID NO: 111769
  derived and/or modified sequence opt2 from neuraminidase__InfluenzaA__AGJ73374

SEQ ID NO: 114936 - RNA, 1410 nt, Artificial Sequence
  derived and/or modified sequence opt2 from neuraminidase__InfluenzaA__AGJ73376
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagauccuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaccaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114937 - RNA, 1410 nt, Artificial Sequence
  derived and/or modified sequence opt2 from neuraminidase__InfluenzaA__AGJ73379
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114938 - RNA, 1410 nt, Artificial Sequence
  derived and/or modified sequence opt2 from neuraminidase__InfluenzaA__AGJ73381
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacgagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114939 - RNA, 1410 nt, Artificial Sequence
  derived and/or modified sequence opt2 from neuraminidase__InfluenzaA__AGK62992
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgaggucaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114940 - RNA, 1410 nt, Artificial Sequence
  derived and/or modified sequence opt2 from neuraminidase__InfluenzaA__AGK62996
augaaccccaaccagaagaucaucaccaucggcuccgucucccucaucaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgaguccaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114941 - RNA, 1410 nt, Artificial Sequence
  derived and/or modified sequence opt2 from neuraminidase__InfluenzaA__AGK62998
augaaccccaaccagaagaucaucaccaucggcuccgucucccucaccaucgccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccuccucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgaguccaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114942 - RNA, 1410 nt, Artificial Sequence
  derived and/or modified sequence opt2 from neuraminidase__InfluenzaA__AGK63000
augaaccccaaccagaagaucaucaccaucggcuccgucucccucaccaucgccaccaucugcuucuucaugcagaucgccauccucaucaccaccgucacccuccacuucaagcagugcgacuucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114943 - RNA, 1410 nt, Artificial Sequence
  derived and/or modified sequence opt2 from neuraminidase__InfluenzaA__AGK63002
augaaccccaaccagaagaucaucaccaucggcuccgucucccucaccaucuccaccaucugcuucuucaugcagaucgccauccucaugaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcaacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaccgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114944 - RNA, 1410 nt, Artificial Sequence
  derived and/or modified sequence opt2 from neuraminidase__InfluenzaA__AGK63004
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccucccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114945 - RNA, 1410 nt, Artificial Sequence
  derived and/or modified sequence opt2 from neuraminidase__InfluenzaA__AGK63006
augaaccccaaccagaagaucaucaccaucggcuccgucucccucaccaucgccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccgccaaggccgacaccaagauccucuucaucgaggagggcaagaucguccacaccuccacccucuccggcuccgcccagcacgucgaggagugcuccugcuacccccgcuacuccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaagucccagcuccagaucaaccgccaggucaucgucgaccgcggcgaccgcuccggcuacuccggcaucuucuccgucgaguccaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114946 - RNA, 1410 nt, Artificial Sequence
  derived and/or modified sequence opt2 from neuraminidase__InfluenzaA__AGK63008
augaaccccaaccagaagaucaucaccaucggcuccgucucccucaccaucgccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaugaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114947 - RNA, 1410 nt, Artificial Sequence
  derived and/or modified sequence opt2 from neuraminidase__InfluenzaA__AGK63010
augaaccccaaccagaagaucaucaccaucggcuccgucucccucaccaucgccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccgaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114948 - RNA, 1410 nt, Artificial Sequence
  derived and/or modified sequence opt2 from neuraminidase__InfluenzaA__AGK63012
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcuaccgcuccggcuacuccggcaucuucuccgucgagggcaaguccugcaucaaccgcugcuucuacgucgaccucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114949 - RNA, 1410 nt, Artificial Sequence
  derived and/or modified sequence opt2 from neuraminidase__InfluenzaA__AGK63014
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuucccccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccaccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114950 - RNA, 1410 nt, Artificial Sequence
  derived and/or modified sequence opt2 from neuraminidase__InfluenzaA__AGK63018
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114951 - RNA, 1410 nt, Artificial Sequence
  derived and/or modified sequence opt2 from neuraminidase__InfluenzaA__AGK63020
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114952 - RNA, 1410 nt, Artificial Sequence
  derived and/or modified sequence opt2 from neuraminidase__InfluenzaA__AGK63022
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgaccucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114953 - RNA, 1410 nt, Artificial Sequence; identical to SEQ ID NO: 114951
  derived and/or modified sequence opt2 from neuraminidase__InfluenzaA__AGK63024

SEQ ID NO: 114954 - RNA, 1410 nt, Artificial Sequence; identical to SEQ ID NO: 114951
  derived and/or modified sequence opt2 from neuraminidase__InfluenzaA__AGK63026

SEQ ID NO: 114955 - RNA, 1410 nt, Artificial Sequence
  derived and/or modified sequence opt2 from neuraminidase__InfluenzaA__AGK63028
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaagaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaaggucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgaggccaaguccugcaucauccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114956 - RNA, 1410 nt, Artificial Sequence; identical to SEQ ID NO: 114950
  derived and/or modified sequence opt2 from neuraminidase__InfluenzaA__AGK63030

SEQ ID NO: 114957 - RNA, 1410 nt, Artificial Sequence
  derived and/or modified sequence opt2 from neuraminidase__InfluenzaA__AGK63032
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaccgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114958 - RNA, 1410 nt, Artificial Sequence
  derived and/or modified sequence opt2 from neuraminidase__InfluenzaA__AGK63034
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagguccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaagaaggagaccgagguccucuggaccuccaacuccaucgucgucuucugcggcaccuccggcaccuacggcaccggcuccuggcccgacggcgccgacaucaaccucaugcccaucuga

SEQ ID NO: 114959 - RNA, 1410 nt, Artificial Sequence
  derived and/or modified sequence opt2 from neuraminidase__InfluenzaA__AGK63036
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgcuucggcuacgagaccaucaaggucaucgagggcugguccaaccccaaguccaaccuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114960 - RNA, 1410 nt, Artificial Sequence
  derived and/or modified sequence opt2 from neuraminidase__InfluenzaA__AGK63038
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgaguccaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114961 - RNA, 1410 nt, Artificial Sequence
  derived and/or modified sequence opt2 from neuraminidase__InfluenzaA__AGK63040
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114962 - RNA, 1410 nt, Artificial Sequence
  derived and/or modified sequence opt2 from neuraminidase__InfluenzaA__AGK63042
augaaccccaaccagaagaucaucaccaucggcuccgucucccucaccaucuccaccaucugcuucuucaugcagaucgccauccucaucaccaccgucacccuccacuucaagcagugcgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114963 - RNA, 1410 nt, Artificial Sequence
  derived and/or modified sequence opt2 from neuraminidase__InfluenzaA__AGK63044
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcuaccgcuccggcuacuccggcaucuucuccgucgaguccaaguccugcaucaaccgcugcuucuacgucgagcuccuccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114964 - RNA, 1410 nt, Artificial Sequence
  derived and/or modified sequence opt2 from neuraminidase__InfluenzaA__AGK63046
augaaccccaaccagaagaucaucaccaucggcuccgucucccucaccaucuccaccaucugcuucuucaugcagaucgccauccucaucaccaccgucacccuccacuucaagcacuacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgaccucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 114965 - RNA, 1398 nt, Artificial Sequence
  derived and/or modified sequence opt2 from neuraminidase__InfluenzaA__AGK82159
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacgagaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 114966 - RNA, 1398 nt, Artificial Sequence
  derived and/or modified sequence opt2 from neuraminidase__InfluenzaA__AGK84858
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 114967 - RNA, 1398 nt, Artificial Sequence
  derived and/or modified sequence opt2 from neuraminidase__InfluenzaA__AGK84861
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucguccagaucgaccccgucgccaugacccacaccucccaguacaucugcucccccguccucaccgacaacccccgccccaacgaccccaacaucggcaagugcaacgaccccuaccccggcaucaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 114968 - RNA, 1398 nt, Artificial Sequence; identical to SEQ ID NO: 114966
  derived and/or modified sequence opt2 from neuraminidase__InfluenzaA__AGK84864

SEQ ID NO: 114969 - RNA, 1398 nt, Artificial Sequence
  derived and/or modified sequence opt2 from neuraminidase__InfluenzaA__AGL95090
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaacaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugcaaggacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 114970 - RNA, 1413 nt, Artificial Sequence; identical to SEQ ID NO: 108144
  derived and/or modified sequence opt2 from neuraminidase__InfluenzaA__AGL96802

SEQ ID NO: 114971 - RNA, 1413 nt, Artificial Sequence; identical to SEQ ID NO: 108144
  derived and/or modified sequence opt2 from neuraminidase__InfluenzaA__AGL96807

SEQ ID NO: 114972 - RNA, 1413 nt, Artificial Sequence
  derived and/or modified sequence opt2 from neuraminidase__InfluenzaA__AGL96808
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccuucuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114973 - RNA, 1413 nt, Artificial Sequence
  derived and/or modified sequence opt2 from neuraminidase__InfluenzaA__AGL96809
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaagaccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114974 - RNA, 1413 nt, Artificial Sequence; identical to SEQ ID NO: 108144
  derived and/or modified sequence opt2 from neuraminidase__InfluenzaA__AGL96818

SEQ ID NO: 114975 - RNA, 1413 nt, Artificial Sequence
  derived and/or modified sequence opt2 from neuraminidase__InfluenzaA__AGL96820
augaaccccaaccagaagaucaucaccaccggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114976 - RNA, 1413 nt, Artificial Sequence
  derived and/or modified sequence opt2 from neuraminidase__InfluenzaA__AGL96821
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucuccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 114977 - RNA, 1410 nt, Artificial Sequence
  derived and/or modified sequence opt2 from neuraminidase__InfluenzaA__AGN69269
augaucaccaaccagcgcaucaucaccaucggcaccgucugccucaucgucggcaucgucucccuccuccuccagaucggcaacaucgucucccucuggaucucccacuccauccagaccggcgagaagaaccacuccgagaucugcaaccagaacaccaucaccuacgagaacaacaccugggucaaccagaccuacgucaacaucuccaacaccaacaucgccgacggccagggcgucaccuccaucauccucgccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggaucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccgcccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucgacuccgagaccgccuccugguccuggcccgacggcgccgaccuccccuucaccaucgacaaguga

SEQ ID NO: 114978 - RNA, 1410 nt, Artificial Sequence
  derived and/or modified sequence opt2 from neuraminidase__InfluenzaA__AGN69280
augaacaccaaccagcgcaucaucaccaucggcaccgucugccucaucgucggcaucgucucccuccuccuccagaucggcaacaucgucucccucuggaucucccacuccauccagaccggcgagaagaaccacuccgagaucugcaaccagaacaccaucaccuacgagaacaacaccugggucaaccagaccuacgucaacaucuccaacaccaacaucgccgacggccagggcgucaccuccaucauccucgccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccggcggcuccuccaucuccuucugcggcgucgacuccgagaccgccuccugguccuggcccgacggcgccgaccuccccuucaccaucgacaaguga

SEQ ID NO: 114979 - RNA, 1410 nt, Artificial Sequence
  derived and/or modified sequence opt2 from neuraminidase__InfluenzaA__AGN69292
augaaccccaaccagaagaucaucaccaucggcuccaucugcaugaccaucggcaucgccucccucauccuccagaucggcaacaucaucuccaucuggaucucccacuccauccagaccgagaaccagaaccagcccgagaucugcaaccagaacgucaucaccuacgagaacaacaccugggucaaccagaccuacgucaacaucuccaacaccaacuucgucgccgagcaggccgucgccuccgucaagcucgccggcaacuccucccucugccccgucuccggcugggccaucuacuccaaggacaacuccguccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaagaacauccuccgcacccaggaguccgagugcgccugcgucaacggcuccugcuucaccgucaugaccgacggccccuccaacggccaggccuccuacaaggucuucaagaucgagaagggcaaggucgucaaguccgucgagcucaacgcccccaacuaccacuacgaggagugcuccugcuaccccgaguccggcgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuucuccaacggcgccaacggcgucaagggcuucuccuucaaguacggcaacggcgucuggaucggccgcaccaaguccaucuccucccgcaugggcuucgagaugaucugggaccccgacggcuggaccaagaccgacgacaaguucuccgucaagcaggacaucaucggcaucaacgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114980 - RNA, 1410 nt, Artificial Sequence
  derived and/or modified sequence opt2 from neuraminidase__InfluenzaA__AGN69316
augaaccccaaccagaagaucaucaccaucggcuccaucugcaugaccaucggcaucgccucccucauccuccagaucggcaacaucaucuccaucuggaucucccacuccauccagaccgagaaccagaaccagcccgagaucugcaaccagaacgucaucaccuacgagaacaacaccugggucaaccagaccuacgucaacaucuccaacaccaacuucgucgccgagcaggccgucgccuccgucaagcucgccggcaacuccucccucugccccgucuccggcugggccaucuacuccaaggacaacuccguccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaagaacauccuccgcacccaggaguccgagugcgccugcgucaacggcuccugcuucaccgucaugaccgacggccccuccaacggccaggccuccuacaaggucuucaagaucgagaagggcaaggucgucaagaccgucgagcucaacgcccccaacuaccacuacgaggagugcuccugcuaccccgaguccggcgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuucuccaacggcgccaacggcgucaagggcuucuccuucaaguacggcaacggcgucuggaucggccgcaccaaguccaucuccucccgcaugggcuucgagaugaucugggaccccgacggcuggaccaagaccgacgacaaguucuccgucaagcaggacaucaucggcaucaacgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114981 - RNA, 1410 nt, Artificial Sequence; identical to SEQ ID NO: 114980
  derived and/or modified sequence opt2 from neuraminidase__InfluenzaA__AGN69328

SEQ ID NO: 114982 - RNA, 1410 nt, Artificial Sequence
  derived and/or modified sequence opt2 from neuraminidase__InfluenzaA__AGN69340
augaaccccaaccagaagaucaucaccaucggccucaucugcaugaccaucggcaucgccucccucauccuccagaucggcaacaucaucuccaucuggaucucccacuccauccagaccgagaaccagaacaagcccgagaucugcaaccagaacgucaucaccuacgagaacaacaccugggucaaccagaccuacgucaacgucuccaacaccaacuucgucgccgagcaggccgucgccuccgucaagcucgucggcaacuccucccucugccccgucuccggcugggccaucuacuccaaggacaacuccguccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaagaacauccuccgcacccaggaguccgagugcgccugcgucaacggcuccugcuucaccgucaugaccgacggccccuccaacggccaggccuccuacaaggucuucaagaucgagcgcggcaaggucgucaaguccgucgagcucaacgcccccaacuaccacuacgaggagugcuccugcuaccccgaguccuccgagaucaccugcgucugccgcgacaacuggcacggcuccaaccgccccugggucuccuucaaccagaaccucgaguaccagaugggcuacaucugcuccggcgucuucggcgacaacccccgccccaacgacaagaccggcuccugcggccccgucuucuccaacggcgccaacggcgucaagggcuucuccuucaaguacggcaacggcgucuggaucggccgcaccaaguccaccuccucccgcaugggcuucgagaugaucugggaccccgacggcuggaccaagaccgacgacaaguucuccgucaagcaggacaucaucggcaucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 114983 - RNA, 1410 nt, Artificial Sequence
  derived and/or modified sequence opt2 from neuraminidase__InfluenzaA__AGO00268
augaaccccaaccagaagaucaucaccaucggcuccaucugcauggucgucggcaucaucucccucauccuccagaucggcaacaucaucuccaucuggaucucccacuccauccagaccggcucccagaaccacaccggcaucugcaaccaguccaucaucaccuacaagaacuccaccugggucaaccagaccuacgucaacaucuccaacaccaacgucgucgccggcaaggacaccaccuccaugauccucgccggcaacuccucccucugccccauccgcggcugggccaucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggaagaagaagauccuccgcacccaggaguccgagugcgucugcgucaacggcuccugcuucaccaucaugaccgacggccccuccgacggccccgccuccuacaagaucuucaagaucgagaagggcaaggucaccaaguccaucgagcucgacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaagggcuccugcggccccgucuacgucgacggcgccaacggcgucaagggcuucuccuaccgcuacggcgacggcgucuggaucggccgcaccaaguccaacuccucccgccagggcuucgagaugaucugggaccccaacggcuggaccgagaccgacuccuccuucuucgucaagcaggacgucgucgccaugaccgacugguccggcuacuccggcuccuucguccagcaccccgagcucaccggccucaacugcaugcgccccugcuucugggucgagcucauccgcggccgccccaaggagaagaccaucuggaccuccggcuccuccaucuccuucugcggcgucaacuccgacaccgucgacugguccuggcccgacggcgccgagcuccccuucaccaucgacaaguga

SEQ ID NO: 114984 - RNA, 1410 nt, Artificial Sequence
  derived and/or modified sequence opt2 from neuraminidase__InfluenzaA__AGO00280
augaaccccaaccagaagaucaucaccaucggcuccaucugcauggucgucggcaucaucucccucauccuccagaucggcaacaucgucuccaucuggaucucccacuccauccagaccggcaaccagaaccacaccggcaccugcaaccaguccaucaucaccuacaagaacuccaccugggucaaccagaccuacgucaacaucuccaacaccaacgucgucgccggcaaggacaccaccuccgucauccucgccggcaacuccucccucugccccauccgcggcugggccaucuacuccaaggacaacggcguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaaggagauccuccgcacccaggaguccgagugcgucugcgucaacggcuccugcuucaccaucaugaccgacggccccuccggcggccccgccuccuacaagaucuucaagaucgagaagggcaaggucaccaaguccaucgagcucgacgcccccaacucccacuacgaggagugcuccugcuaccccgacaccuccaaggucaugugcgucugccgcgacaacuggcacggcuccaaccgccccugggucuccuucgaccagaaccucgacuaccagaugggcuacaucugcuccggcgucuucggcgacaacccccgccccaaggacggcaagggcuccugcggccccgucuacgucgacggcgccaacggcgucaagggcuucuccuaccgcuacggcaacggcgucuggaucggccgcaccaaguccaacuccucccgccagggcuucgagaugaucugggaccccaacggcuggaccgagaccgacuccaacuucuucaugaagcaggacgucgucgccgucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 114985 - RNA, 1413 nt, Artificial Sequence
  derived and/or modified sequence opt2 from neuraminidase__InfluenzaA__AGO00292
augaaccccaaccagaagaucaucaccaucggcuccaucugcaugaccaucggcaccaucucccucauccuccagaucggcaacaucaucuccaucuggaucucccacuccauccagaccggcucccagaaccacaccggcaucugcaaccagcgcaucaucaccuacgagaacaacaccugggucaaccagaccuacgucaacaucuccaacaccaacgucgucgccggcaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaucaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcgacggcgucuggaucggccgcaccaaguccaacuccucccgcaagggcuucgagaugaucugggaccccaacggcuggaccgacaccgacgacaacuuccucgucaagcaggacgucgucgccaugaccgacugguccggcuacuccggcuccuucguccagcaccccgagcucaccggccucgacugcauccgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacauguga

SEQ ID NO: 114986 - RNA, 1413 nt, Artificial Sequence
  derived and/or modified sequence opt2 from neuraminidase__InfluenzaA__AGO00304
augaaccccaaccagaagaucaucaccaucggcuccaucugcauggccaucggcaccaucucccucauccuccagaucggcaacaucaucuccaucuggaucucccacuccauccagaccggcucccagaaccacaccggcaucugcaaccagcgcaucaucaccuacgagaacaacaccugggucaaccagaccuacgucaacaucuccaacaccaacgucgucgccggcaaggacaccaccuccaugauccucgccggcaacaccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaucaucaaguccuggcgcaagcagauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccaacaccgacggcaacuucuccgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 114987 - RNA, 1410 nt, Artificial Sequence; identical to SEQ ID NO: 114056
  derived and/or modified sequence opt2 from neuraminidase__InfluenzaA__AGO00316

SEQ ID NO: 114988 - RNA, 1410 nt, Artificial Sequence; identical to SEQ ID NO: 113500
  derived and/or modified sequence opt2 from neuraminidase__InfluenzaA__AGO00328

SEQ ID NO: 114989 - RNA, 1410 nt, Artificial Sequence; identical to SEQ ID NO: 105607
  derived and/or modified sequence opt2 from neuraminidase__InfluenzaA__AGO00340

SEQ ID NO: 114990 - RNA, 1365 nt, Artificial Sequence; identical to SEQ ID NO: 107231
  derived and/or modified sequence opt2 from neuraminidase__InfluenzaA__AGO00352

SEQ ID NO: 114991 - RNA, 1365 nt, Artificial Sequence; identical to SEQ ID NO: 107231
  derived and/or modified sequence opt2 from neuraminidase__InfluenzaA__AGO00376

SEQ ID NO: 114992 - RNA, 1365 nt, Artificial Sequence; identical to SEQ ID NO: 107231
  derived and/or modified sequence opt2 from neuraminidase__InfluenzaA__AGO00388

SEQ ID NO: 114993 - RNA, 1365 nt, Artificial Sequence; identical to SEQ ID NO: 107231
  derived and/or modified sequence opt2 from neuraminidase__InfluenzaA__AGO00400

SEQ ID NO: 114994 - RNA, 1365 nt, Artificial Sequence; identical to SEQ ID NO: 107231
  derived and/or modified sequence opt2 from neuraminidase__InfluenzaA__AGO00412

SEQ ID NO: 114995 - RNA, 1365 nt, Artificial Sequence; identical to SEQ ID NO: 107231
  derived and/or modified sequence opt2 from neuraminidase__InfluenzaA__AGO00424

SEQ ID NO: 114996 - RNA, 1365 nt, Artificial Sequence
  derived and/or modified sequence opt2 from neuraminidase__InfluenzaA__AGO00436
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccuccggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacuccaacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucuccaucgacaaguga

SEQ ID NO: 114997 - RNA, 1365 nt, Artificial Sequence
  derived and/or modified sequence opt2 from neuraminidase__InfluenzaA__AGO00448
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccuccggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuaccgcaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucuccaucgacaaguga

SEQ ID NO: 114998 - RNA, 1410 nt, Artificial Sequence
  derived and/or modified sequence opt2 from neuraminidase__InfluenzaA__AGQ47722
augaacaccaaccagcgcaucaucaccaucggcaccaucugccucaucgucggcaucaucucccuccuccuccagaucggcaacaucaucucccucuggaucucccacuccauccagaccggcgagaagucccaccccgagaucugcaaccaguccgucaucaccuacgagaacaacaccugggucaaccagaccuacgucaacaucuccaacaccaacaucgccgccggccagggcgucacccccaucauccucgccggcaacuccucccucugccccaucuccggcugggccaucuacuccaaggacaacuccauccgcaucggcuccaagggcgacaucuucgucaugcgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccaucgagcucgacgcccccaacuaccacuacgaggagugcuccugcuaccccgacaccggcaaggucaugugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagauggucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucaacuccggcaccgccuccugguccuggcccgacggcgccgaccuccccuucaccaucgacaaguga

SEQ ID NO: 114999 - RNA, 1413 nt, Artificial Sequence; identical to SEQ ID NO: 107965
  derived and/or modified sequence opt2 from neuraminidase__InfluenzaA__AGQ47731

SEQ ID NO: 115000 - RNA, 1377 nt, Artificial Sequence
  derived and/or modified sequence opt2 from neuraminidase__InfluenzaA__AGQ47743
augaaccccaaccagaagaucaucaccaucggcuccaucugcauggucgucggcaucaucucccucauccuccagaucggcaacaucaucuccaucuggaucucccacuccauccagaccggcaaccagaaccacaagaacuccaccuggaugaaccagaccuacaucaacaucuccaacaccaacgucgucgccggccaggacuccaccuccgucauccucaccggcaacuccucccucugccccauccgcggcugggccaucaacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcaccugcgucaacggcuccugcuucaccaucaugaccgacggccccuccaacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuccgccgacggcgccaacggcgucaagggcuucuccuaccgcuacggcaacggcgucuggaucggccgcaccaaguccaacuccucccgccacggcuucgagaugaucugggaccccaacggcuggaccgagaccgacucccgcuucuccguccgccaggacgucgucgccaugaccgaccgcuccggcuacuccggcuccuucguccagcaccccgagcucaccggccucgacugcaugcgccccugcuucugggucgagcucauccgcggccgccccgaggaggagaccaucuggaccuccggcuccaucaucuccuucugcggcgucaacuccgacaccgucgacugguccuggcccgacggcgccgagcuccccuucaccaucgacaaguga

SEQ ID NO: 115001 - RNA, 1413 nt, Artificial Sequence
  derived and/or modified sequence opt2 from neuraminidase__InfluenzaA__AGQ47755
augaaccccaaccagaagaucaucaccaucggcuccaucugcauggccaucggcaccaucucccucauccuccagaucggcaacaucaucuccaucuggaucucccacuccauccagaccggcucccagaaccacaccggcaucugcaaccgccgcaucgucaccuacgagaacaacaccugggucaaccagaccuacgucaacaucuccaacaccaacgucgucgccgagaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaucaucaaguccuggcgcaagcagauccuccgcacccaggaguccgagugcgucugcgucaacggcuccugcuucaccaucaugaccgacggccccuccaacggccccgccuccuaccgcaucuucaagaucaagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaccuccucccgcaagggcuucgagaugaucugggaccccaacggcuggaccgacaccgacggcaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 115002 - RNA, 1410 nt, Artificial Sequence
  derived and/or modified sequence opt2 from neuraminidase__InfluenzaA__AGQ47767
augaaccccaaccagaagaucaucaccaucggcuccaucugcauggucgucggcaucaucucccucauccuccagaucggcaacaucgucuccaucuggaucucccacuccauccagaccggcaaccagaaccacaccggcaccugcgaccaguccaucaucaccuacaagaacuccaccugggucaaccagaccuacgucaacaucuccaacaccaacgucgucgccggcaaggacaccaccuccgucauccucgccggcaacuccucccucugccccauccgcggcugggccaucuacuccaaggacaacggcguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaaggagauccuccgcacccaggaguccgagugcgucugcgucaacggcuccugcuucaccaucaugaccgacggccccuccggcggccccgccuccuacaagaucuucaagaucgagaagggcaaggucaccaaguccaucgagcucgacgcccccaacucccacuacgaggagugcuccugcuaccccgacaccuccaaggucaugugcgucugccgcgacaacuggcacggcuccaaccgccccugggucuccuucgaccagaaccucgacuaccagaugggcuacaucugcuccggcgucuucggcgacaacccccgccccaaggacggcaagggcuccugcggccccgucuacgucgacggcgccaacggcgucaagggcuucuccuacaaguacggcaacggcgucuggaucggccgcaccaaguccaacuccucccgccagggcuucgagaugaucugggaccccaacggcuggaccgagaccgacuccaacuucuucaccaagcaggacgucgucgccgucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 115003 - RNA, 1410 nt, Artificial Sequence; identical to SEQ ID NO: 114984
  derived and/or modified sequence opt2 from neuraminidase__InfluenzaA__AGQ47779

SEQ ID NO: 115004 - RNA, 1413 nt, Artificial Sequence
  derived and/or modified sequence opt2 from neuraminidase__InfluenzaA__AGQ47791
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacaacaccugggucaaccagacccacgucaacaucuccaacaccaacgucgucgccggcaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacggcaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 115005 - RNA, 1410 nt, Artificial Sequence
  derived and/or modified sequence opt2 from neuraminidase__InfluenzaA__AGQ47803
augaaccccaaccagaagaucaucaccaucggcuccaucugcauggucgucggcaucaucucccucauccuccagaucggcaacaucaucuccaucuggaucucccacuccauccagaccggcucccagaaccacaccggcaucugcaaccaguccaucaucaccuacaagaacuccaccugggucaaccagaccuacgucaacaucuccaacaccaacgucgucgccggcaagggcaccaccuccgucauccucgccggcaacuccucccucugccccauccgcggcugggccaucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccugcgccugccacgacggcaugggcuggcucaccaucggcaucuccggccccgacgacgaggccgucgccguccucaaguacaacggcaucaucaccgagaccaucaaguccuggcgcaagaagauccuccgcacccaggaguccgagugcgucugcgucaacggcuccugcuucaccaucaugaccgacggccccuccgacggccccgccuccuacaagaucuucaagaucgagaagggcaaggucaccaaguccaucgagcucgacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaagggcuccugcggccccgucuacgucgacggcgccaacggcgucaagggcuucuccuaccgcuacggcaacggcgucuggaucggccgcaccaaguccgacuccucccgccagggcuucgagaugaucugggaccccaacggcuggaccgagaccgacuccaacuucuucgucaagcaggacaucgucgccaugaccgacugguccggcuacuccggcuccuucguccagcaccccgagcucaccggccucgacugcaugcgccccugcuucugggucgagcucauccgcggccgccccaaggagaagaccaucuggaccuccggcuccuccaucuccuucugcggcgucaacuccgacaccgucgacugguccuggcccgacggcgccgagcuccccuucaccaucgacaaguga

SEQ ID NO: 115006 - RNA, 1368 nt, Artificial Sequence
  derived and/or modified sequence opt2 from neuraminidase__InfluenzaA__AGQ47814
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacaacaccugggucaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacggcaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 115007 - RNA, 1413 nt, Artificial Sequence; identical to SEQ ID NO: 107969
  derived and/or modified sequence opt2 from neuraminidase__InfluenzaA__AGQ47826

SEQ ID NO: 115008 - RNA, 1410 nt, Artificial Sequence
  derived and/or modified sequence opt2 from neuraminidase__InfluenzaA__AGQ47838
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucggcuaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcaccaagcaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 115009 - RNA, 1362 nt, Artificial Sequence
  derived and/or modified sequence opt2 from neuraminidase__InfluenzaA__AGQ47850
augaaccccaaccagaagaucaucaccaucggcuccaucugcauggucgucggcaucaucucccucauccuccagaucggcaacaucaucuccaucuggaucucccacuccauccaggccggcuccuccaccugggucaaccagaccuacgucaacaucuccaacaccaacgucgucgccggccccgacgccaccuccgucauccucaccggcaacuccucccucugccccauccgcggcugggccaucuacuccaaggacaacggcauccgcaucggcuccaagggcgacaucuucgucauccgcgagcccuucaucuccugcucccaccucgagugccgcgccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccccgccuccuacaagaucuucaagaucgagaagggcaaggucaccaaguccaucgagcucgacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacuccccccgccccaaggacggcaccggcuccugcggccccgucuccgucgacggcgccaacggcgucaagggcuucuccuaccgcuacggcaacggcgucuggaucggccgcaccaaguccaaguccucccgccacggcuucgagaugaucugggaccccaacggcuggaccgagaccgacucccgcuucuccguccgccaggacgucgucgccaugaccgacugguccggcuacuccggcuccuucguccagcaccccgagcucaccggccucgacugcaugcgccccugcuucugggucgagcucauccgcggccagcccaaggagaagaccaucuggaccuccggcuccuccaucuccuucugcggcgucaacuccgacaccgucgacugguccuggcccgacggcgccgagcuccccuucaccaucgacaaguga

SEQ ID NO: 115010 - RNA, 1410 nt, Artificial Sequence
  derived and/or modified sequence opt2 from neuraminidase__InfluenzaA__AGQ47873
augaacaccaaccagcgcaccaucaccaucggcaccaucugccucaucgucggcaucaucucccuccuccuccagaucggcaacaucauccuccucuggaugucccacuccauccagaccggcgagaagucccaccccaaggucugcaaccaguccgucaucaccuacgagaacaacaccugggucaaccagaccuacgucaacaucuccaacaccaacaucgccgccggccagggcgucacccccaucauccucgccggcaacuccucccucugccccaucuccggcugggccaucuacuccaaggacaacuccauccgcaucggcuccaagggcgacaucuucgucaugcgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagcucuucaagauggagaagggcaagaucaucaaguccaucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucaacuccggcaccgccuccugguccuggcccgacggcgccgaccuccccuucaccaucgacaaguga

SEQ ID NO: 115011 - RNA, 1410 nt, Artificial Sequence; identical to SEQ ID NO: 108726
  derived and/or modified sequence opt2 from neuraminidase__InfluenzaA__AGQ47885

SEQ ID NO: 115012 - RNA, 1410 nt, Artificial Sequence; identical to SEQ ID NO: 113492
  derived and/or modified sequence opt2 from neuraminidase__InfluenzaA__AGQ47897

SEQ ID NO: 115013 - RNA, 1410 nt, Artificial Sequence; identical to SEQ ID NO: 105607
  derived and/or modified sequence opt2 from neuraminidase__InfluenzaA__AGQ47909

SEQ ID NO: 115014 - RNA, 1410 nt, Artificial Sequence
  derived and/or modified sequence opt2 from neuraminidase__InfluenzaA__AGQ47921
augaaccccaaccagaagaucaucaccaucggcuccgucucccucaccaucgccaccgucugcuuccucaugcagaccgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggaggcccgcgucugguggaccuccaacuccaucgucgucuucugcggcaccuccggcaccuacggcaccggcuccuggcccgacggcgccaacaucaacuucaugcccaucuga

SEQ ID NO: 115015 - RNA, 1365 nt, Artificial Sequence
  derived and/or modified sequence opt2 from neuraminidase__InfluenzaA__AGQ47933
augaaccccaaccagaagaucaucaccaucggcuccaucugcauggucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgaccgccacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcauccgccccugcuucugggucgagcucauccgcggccgccccaaggagaagaccaucuggaccuccgccuccuccaucuccuucugcggcgucaacuccgacaccgucaacugguccuggcccgacggcgccgagcuccccuucaccaucgacaaguga

SEQ ID NO: 115016 - RNA, 1365 nt, Artificial Sequence; identical to SEQ ID NO: 107231
  derived and/or modified sequence opt2 from neuraminidase__InfluenzaA__AGQ47945

SEQ ID NO: 115017 - RNA, 1365 nt, Artificial Sequence; identical to SEQ ID NO: 107231
  derived and/or modified sequence opt2 from neuraminidase__InfluenzaA__AGQ47957

SEQ ID NO: 115018 - RNA, 1365 nt, Artificial Sequence; identical to SEQ ID NO: 107231
  derived and/or modified sequence opt2 from neuraminidase__InfluenzaA__AGQ47969

SEQ ID NO: 115019 - RNA, 1365 nt, Artificial Sequence; identical to SEQ ID NO: 107231
  derived and/or modified sequence opt2 from neuraminidase__InfluenzaA__AGQ47981

SEQ ID NO: 115020 - RNA, 1365 nt, Artificial Sequence
  derived and/or modified sequence opt2 from neuraminidase__InfluenzaA__AGQ48005
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccuccggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacuccaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucuccaucgacaaguga

SEQ ID NO: 115021 - RNA, 1365 nt, Artificial Sequence; identical to SEQ ID NO: 115020
  derived and/or modified sequence opt2 from neuraminidase__InfluenzaA__AGQ48017

SEQ ID NO: 115022 - RNA, 1365 nt, Artificial Sequence; identical to SEQ ID NO: 107231
  derived and/or modified sequence opt2 from neuraminidase__InfluenzaA__AGQ48029

SEQ ID NO: 115023 - RNA, 1365 nt, Artificial Sequence
  derived and/or modified sequence opt2 from neuraminidase__InfluenzaA__AGQ48041
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccuggaucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccuccggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucuccaucgacaaguga

SEQ ID NO: 115024 - RNA, 1365 nt, Artificial Sequence
  derived and/or modified sequence opt2 from neuraminidase__InfluenzaA__AGQ48053
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccuggaucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccuccggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccauggccgacugguccggcuacuccggcuccuucguccagcaccccgagcucaccggccucgacugcaugcgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucuccaucgacaaguga

SEQ ID NO: 115025 - RNA, 1410 nt, Artificial Sequence
  derived and/or modified sequence opt2 from neuraminidase__InfluenzaA__AGQ81707
augaaccccaaccagaagaucaucaccaucggcuccaucugcauggucaucggcaucgccucccucaugcuccagaucggcaacaugaucuccaucugggucucccacuccauccagaccggcaaccaguaccagcccgagcccugcaaccaguccaucaucaccuacgagaacaacaccugggucaaccagaccuacgucaacaucuccaacaccaacuuccucaccgagcaggccgucaccuccgucgcccucgccggcaacuccucccucugccccaucuccggcugggccaucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaucgagaagggcaaggucgucaaguccgucgagcucaacgcccccaacuaccacuacgaggagugcuccugcuaccccgacgccggcaagaucaugugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccuccucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucgacuccgacaccgucggcugguccuggcccgacggcgccgagcuccccuucaccaucgacaaguga

SEQ ID NO: 115026 - RNA, 1410 nt, Artificial Sequence
  derived and/or modified sequence opt2 from neuraminidase__InfluenzaA__AGQ81715
augaaccccaaccagaagaucaucgccaucggcuccgucucccucaccaucgccaccaucugccuccucaugcagaucgccauccucgucaccaccaugacccuccacuucaagcacaacgagugcaccaacuccuccaacaaccaggccguccccugcggccccaucaucaucgagcgcaacgucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcacccccuaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccggcaacuccuccggcuacuccggcaucuucuccaucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115027 - RNA, 1410 nt, Artificial Sequence
  derived and/or modified sequence opt2 from neuraminidase__InfluenzaA__AGQ81717
augaaccccaaccagaagaucaucgccaucggcuccgucucccucaccaucgccaccaucugccuccucaugcagaucgccauccucgucaccaccaugaccccccacuucaagcacgacgagugcaccaacuccuccaacaaccaggccguccccugcggccccaucaucaucgagcgcaacgucaccgagaucguccacaucaacuccaccauccucgagaaggagaucugccccaaggccgccggcuaccgcaacugguccaagccccagugccagaucaucggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115028 - RNA, 1410 nt, Artificial Sequence
  derived and/or modified sequence opt2 from neuraminidase__InfluenzaA__AGQ81718
augaaccccaaccagaagaucaucgccaucggcuccgucucccucaccaucgccaccaucugccuccucaugcagaucgccauccucgucaccaccaugacccuccacuucaagcacaacgagugcaccaacuccuccaacaaccaggccguccccugcggccccaucaucaucgagcgcaaccucaccgagaucguccaccucaacuccaccauccucgagaaggagaucugccccaaggccgccggcuaccgcaacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucuccaccaagcaggucugcaucgccugguccuccuccuccugccacgacggcaaggccuggcuccacgucugcgucaccggcgacgaccgcaacgccaccgccuccaucaucuacgacggcauccucgucgacuccaucgucuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccgcuaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaccuccuccuccuccaacugccgcgaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcgucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115029 - RNA, 1410 nt, Artificial Sequence
  derived and/or modified sequence opt2 from neuraminidase__InfluenzaA__AGQ81719
augaaccccaaccagaagaucaucgccaucggcuccgucucccucaccaucgccaccaucugccuccucaugcagaucgccauccucgucaccaccaugacccuccacuucaagcacaacgagugcaccaacuccuccaacaaccaggccguccccugcggccccaucaucaucgagcgcaacgucaccgagaucguccaccucaacuccaccacccucgagaaggagaucugcaccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccacccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccaacuccaacugcaaggaccccaacaacgaguccggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccaucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115030 - RNA, 1410 nt, Artificial Sequence
  derived and/or modified sequence opt2 from neuraminidase__InfluenzaA__AGQ81722
augaaccccaaccagaagaucaucgccaucggcuccgucucccucaccaucgccaccaucugccuccucaugcagaucgccauccucgucaccaccaugaccccccacuucaagcacgacgagugcaccaacuccuccaacaaccaggccguccccugcggccccaucaucaucgagcgcaacgucaccgagaucguccacaucaacuccaccauccucgagaagggcaucugccccaaggccgccggcuaccgcaacugguccaagccccagugccagaucaucggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115031 - RNA, 1410 nt, Artificial Sequence
  derived and/or modified sequence opt2 from neuraminidase__InfluenzaA__AGQ81724
augaaccccaaccagaagaucaucgccaucggcuccgucucccucaccaucgccaccaucugccuccucaugcagaucgccauccucgucaccaccaugacccuccacuucaagcacaacgagugcuccaacuccuccaacaaccaggccguccccugcggccccaucaucaucgagcgcaacgucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggaggacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115032 - RNA, 1410 nt, Artificial Sequence
  derived and/or modified sequence opt2 from neuraminidase__InfluenzaA__AGQ81726
augaaccccaaccagaagaucaucgccaucggcuccgucucccucaccaucgccaccaucugccuccucaugcagaucgccauccucgucaccaccaugacccuccacuucaagcacaacgagugcuccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaagcgcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggagucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115033 - RNA, 1410 nt, Artificial Sequence
  derived and/or modified sequence opt2 from neuraminidase__InfluenzaA__AGQ81727
augaaccccaaccagaagaucaucgccaucggcuccgucucccucaccaucgccaccaucugccuccucaugcaggucgccauccucgucaccaccaugacccuccacuucaagcacaacgagugcuccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggccgcgccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggagucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115034 - RNA, 1410 nt, Artificial Sequence
  derived and/or modified sequence opt2 from neuraminidase__InfluenzaA__AGQ81728
augaaccccaaccagaagaucgucgccaucggcuccgucucccucaccaucgccaccaugugccuccucaugcagaucgcccucuucgccaccaccaugacccuccacuucaagcagaccggcuccaccaacuccuccgacaaccaggccguccccugcggccccaucaucaucgagcgcaacaucaccgagaucguccaccucaacuccaccacccucgagaaggagaccugccccaaguccgccggcuaccgcaacugguccaagccccagugccagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacaagcacuccaacggcaccaccuacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgacaagaacgccaccgccuccaucaucuacgacggcauccucgucgacuccaucgccuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgacuccuccuacgucugcuccggcaucgucggcgacaccccccgcaacgacgaccgcuccuccuccuccaacugccgcgaccccaacaacgagaucggcgcccccggcgucaagggcugggccuucgacuccggcaacgacaucuggaugggccgcaccaucgagaaggacucccgcuccggcuacgagaccuuccgcgucaucggcggcugguccaccgccaacuccaagucccagaucaaccgccaggucaucgucgaccgcgacaacuccuccggcuacuccggcaucuucuccgucgagggcaaguccugcaucaaccgcugcuucuacgucgagcucauccgcggccgccccaaggagaaccgcgucugguggaccuccaacuccaucaucgucuucugcggcaccuccggcaccuacggcaccggcuccuggcccgacggcgccaacaucaaccucaugcccaucuga

SEQ ID NO: 115035 - RNA, 1410 nt, Artificial Sequence
  derived and/or modified sequence opt2 from neuraminidase__InfluenzaA__AGQ81729
augaaccccaaccagaagaucaucgccaucggcuccgucucccucaccaucgccaccaucugccuccucaugcagaucgccauccucgucgccaccaugacccuccacuccaagcacggcgagugcaccaacuccuccaacaaccaggccguccccugcggccccaucaucaucgagcgcaacgucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcauccccuuccaccucgccaccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccuccucggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115036 - RNA, 1410 nt, Artificial Sequence
  derived and/or modified sequence opt2 from neuraminidase__InfluenzaA__AGQ81730
augaaccccaaccagaagaucaucgccaucggcuccgucucccucaccaucgccaccaucugccuccucaugcagaucgccauccucgucaccaccaugacccuccacuucaagcacaacgagugcaucaacuccuccaacaaccaguccguccccugcggccccaucaucaucgagcgcaacgucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccuccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcgaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115037 - RNA, 1410 nt, Artificial Sequence
  derived and/or modified sequence opt2 from neuraminidase__InfluenzaA__AGQ81731
augaaccccaaccagaagaucaucgccaucggcuccgucucccucaccaucgccaccaucugccuccucaugcagaucgccauccucgucaccaccaugacccuccacuucaagcacaacgagugcuccaacuccuccaacaaccaggccguccccugcggccccaucaucaucgagcgcaacaucaccgagaucguccaccucaacuccaccacccucgagaaggagaucugccccaagaccgccggcuaccgcgacugguccaagccccagugccagaucaccggcuucgcccccuucuccaaggacaacuccauccgccucuccgccuccggcgacaucugggucacccgcgagcccuacgucuccugcggcuucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacaugaccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggagucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115038 - RNA, 1410 nt, Artificial Sequence
  derived and/or modified sequence opt2 from neuraminidase__InfluenzaA__AGQ81732
augaaccccaaccagaagaucaucgccaucggcuccgucucccucaccaucgccaccaucugccuccucaugcaggucgccauccucgucaccaccaugacccuccacuucaagcacaacgagugcuccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggagucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115039 - RNA, 1410 nt, Artificial Sequence
  derived and/or modified sequence opt2 from neuraminidase__InfluenzaA__AGQ81733
augaaccccaaccagaagaucaucgccaucggcuccgucucccucaccaucgccaccaucugccuccucaugcagaucgccauccucgucaccaccaugacccuccacuucaagcacaacgagugcuccaacuccuccaacucccaggccguccccugcggccccaucaucaucgagcgcaacgucaccgagaucguccaccucaacuccaccacccucgagaaggagaucugccccaaggccgccgaguaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115040 - RNA, 1410 nt, Artificial Sequence
  derived and/or modified sequence opt2 from neuraminidase__InfluenzaA__AGQ81734
augaaccccaaccagaagaucaucgccaucggcuccgucucccucaccaucgccaccaucugccuccucaugcagaucgccauccucgucaccaccaugacccuccacuucaagcacaacgaguacuccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccaagugcgucugcaucaagcgcaccugcaccgucgucaagaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggagucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115041 - RNA, 1410 nt, Artificial Sequence; identical to SEQ ID NO: 115039
  derived and/or modified sequence opt2 from neuraminidase__InfluenzaA__AGQ81735

SEQ ID NO: 115042 - RNA, 1410 nt, Artificial Sequence
  derived and/or modified sequence opt2 from neuraminidase__InfluenzaA__AGQ81736
augaaccccaaccagaagaucaucgccaucggcuccgucucccucaccaucgccaccaucugccuccucaugcagaucgccauccucgucgccaccaugacccuccacuccaagcacggcgagugcaccgacuccuccaacaaccaggccguccccugcggccccaucaucaucgagcgcaacgucaccgagaucguccaccucaacuccaccacccucgagaaggagaucugccccaaggccgccggcuacaaggacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucgcccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115043 - RNA, 1410 nt, Artificial Sequence
  derived and/or modified sequence opt2 from neuraminidase__InfluenzaA__AGQ81737
augaaccccaaccagaagaucaucgccaucggcuccgucucccucaccaucgccaccaucugccuccucaugcagaucgccauccucgucaccaccaugacccuccacuucaagcacaacgagugcuccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggagucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115044 - RNA, 1410 nt, Artificial Sequence
  derived and/or modified sequence opt2 from neuraminidase__InfluenzaA__AGQ81738
augaaccccaaccagaagaucaucgccaucggcuccgucucccucaccaucgccaccaucugccuccucaugcaggucgccauccucgucaccaccaugacccuccacuucaagcacaacgagugcuccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucauccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggagucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115045 - RNA, 1410 nt, Artificial Sequence
  derived and/or modified sequence opt2 from neuraminidase__InfluenzaA__AGQ81739
augaaccccaaccagaagaucaucgccaucggcuccgucucccucaccaucgccaccaucugccuccucaugcagaucgccauccucgucaccaccaugacccuccacuucaagcacgacgagugcaccaacuccuccaacaaccaggccguccccugcgagcccaucaucaucgagcgcaacgucaccgagaucguccacaucaacuccaccauccucgagaaggagaucugccccaaggccgccggcuaccgcaacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcacccucaacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacgacaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucauggccaucuga

SEQ ID NO: 115046 - RNA, 1410 nt, Artificial Sequence
  derived and/or modified sequence opt2 from neuraminidase__InfluenzaA__AGQ81740
augaaccccaaccagaagaucgucgccaucggcuccgucucccucaccaucgccaccaucugccuccucaugcagaucgccauccucgucaccaccaugacccuccacuucaagcacggcgagugcaccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacaacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggaccuccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115047 - RNA, 1410 nt, Artificial Sequence
  derived and/or modified sequence opt2 from neuraminidase__InfluenzaA__AGQ81741
augaaccccaaccagaagaucgucgccaucggcuccgucucccucaccaucgccaccaucugccuccucaugcagaucgccauccucgucaccaccaugacccuccacuucaagcacggcgagugcaccaacuccuccaacaaccaggccguccccugcggccccaucaucaucgagcgcaacaucaccgagaucguccaccucaacuccaccacccucgacaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggaccuccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115048 - RNA, 1410 nt, Artificial Sequence
  derived and/or modified sequence opt2 from neuraminidase__InfluenzaA__AGQ81742
augaaccccaaccagaagaucgucgccaucggcuccgucucccucaccaucgccaccaucugccuccucaugcagaucgccauccucgucaccaccaugacccuccacuucaagcacggcgagugcaccaacuccuccaacaaccaggccguccccugcggccccaucaucaucgagcgcaacaucaccgagaucguccaccucaacuccaccacccucgagaaggagaucugccccaaggccgccgaguaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggaccuccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115049 - RNA, 1410 nt, Artificial Sequence
  derived and/or modified sequence opt2 from neuraminidase__InfluenzaA__AGQ81744
augaaccccaaccagaagaucaucgccaucggcuccgucucccucaccaucgccaccaucugccuccucaugcagaucgccauccucgucaccaccaugacccuccacuuccgccacgacgagugcaccaacuccuccaacaaccaggccguccccugcggccccaucaucaucgagcgcaacgucaccgagaucguccaccucaacuccaccacccucgagaaggagaucugccccaaggccgccgaguaccgcgacugguccaagccccagugccagaucaccggcuucguccccuucuccaaggacaacuccauccgccucuccgccggcggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacgucgccgacuacuccgucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaaccccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115050 - RNA, 1410 nt, Artificial Sequence
  derived and/or modified sequence opt2 from neuraminidase__InfluenzaA__AGQ81746
augaaccccaaccagaagaucaucgccaucggcuccgucucccucaccaucgccaccaucugccuccucaugcagaucgccauccucgucaccaccaugacccuccacuucaagcacaacgagugcuccaacuccuccaacucccaggccguccccugcggccccaucaucaucgagcgcaacgucaccgagaucguccaccucaacuccaccacccucgagaaggagaucugccccaaggccgccgaguaccgcggcugguccaagccccagugccagaucaccggcuucgcccccuucuccaaggacaacuccauccgccucuccgccuccggcgacaucugggucacccgcgagcccuacgucuccugcgaccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115051 - RNA, 1410 nt, Artificial Sequence
  derived and/or modified sequence opt2 from neuraminidase__InfluenzaA__AGQ81747
augaaccccaaccagaagaucgucgccaucggcuccgucucccucaccaucgccaccaucugccuccucaugcagaucgccauccucgucaccaccaugacccuccacuucaagcacggcgagugcaccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggaccuccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115052 - RNA, 1401 nt, Artificial Sequence
  derived and/or modified sequence opt2 from neuraminidase__InfluenzaA__AGQ81749
augaaccccaaccagaagaucaucgccaucggcuccgucucccucaccaccgccaucaucugcuuccucaugcagaucgccauccucaccaccaccaugacccuccacuucaagcagaacgagugcuccaaccccuccaacaaccaggucguccccugcgagcccaucaucaucgagcgcaacaccguccaccucaacuccaccaccaucgagaaggagaucugcuccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgccgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggccgcaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaaggacucccgcuccggcuacgagaccuuccgcgucaucaacggcuggaccaccgccaacuccaagucccagaucaaccgccaggucaucgucgacuccgacaacugguccggcuacuccggcaucuucuccgucgagggcaagaacugcaucaaccgcugcuucuacgucgagcucauccgcggccgcccccaggagcccaaggucugguggaccuccaacuccaucaucgccuucugcggcaccuccggcaccuacggcaccggcuccuggcccgacggcgccaacaucaacuucaugcccaucuga

SEQ ID NO: 115053 - RNA, 1401 nt, Artificial Sequence; identical to SEQ ID NO: 115052
  derived and/or modified sequence opt2 from neuraminidase__InfluenzaA__AGQ81750

SEQ ID NO: 115054 - RNA, 1410 nt, Artificial Sequence
  derived and/or modified sequence opt2 from neuraminidase__InfluenzaA__AGQ81751
augaaccccaaccagaagaucaucgccaucggcuccgucucccucaccaucgccaccaucugccuccucaugcagaucgccauccucgucaccaccaugacccucuacuucaagcacaacgagugcuccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacaucuccuccuccuccaacugcaaggaccccaacaacgagcgcggcgcccccggcgucaagggcugggccuucgacuccggcaacgaccucuggaugggccgcaccaucgagaaggagucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115055 - RNA, 1410 nt, Artificial Sequence
  derived and/or modified sequence opt2 from neuraminidase__InfluenzaA__AGQ81753
augaaccccaaccagaagaucgucgccaucggcuccgucucccucaccaucgccaccaucugccuccucaugcagaucgccauccucgucaccaccaugacccuccacuucaagcacggcgagugcaccaacuccuccaacaaccaggccguccccugcggccccaucaucaucgagcgcaacaucaccggcaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacaucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggaccuccgcuccggcuacgagaccuuccgcgucaucggcggcuggaacaccgccaacuccaagucccagaccaaccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115056 - RNA, 1410 nt, Artificial Sequence; identical to SEQ ID NO: 115055
  derived and/or modified sequence opt2 from neuraminidase__InfluenzaA__AGQ81754

SEQ ID NO: 115057 - RNA, 1410 nt, Artificial Sequence
  derived and/or modified sequence opt2 from neuraminidase__InfluenzaA__AGQ81756
augaaccccaaccagaagaucaucgccaucggcuccaucucccucaccaucgccaccaucugccuccucauccagaucgccauccucgucaccaccaugacccuccacuucaagcacggcgagugcaccaacuccuccaacaaccaggccguccccugcggccccaucaucaucgagcgcaacgucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggccuccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucauccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115058 - RNA, 1410 nt, Artificial Sequence
  derived and/or modified sequence opt2 from neuraminidase__InfluenzaA__AGQ81757
augaaccccaaccagaagaucaucgccaucggcuccgucucccucaccaucgccaccaucugccuccucauccagaucgccauccucgucaccaccaugacccuccacuucaagcacggcgagugcaccaacuccuccaacaaccaggccguccccugcggccccaucaucaucgagcgcaacgucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggccuccucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucauccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggacucccgcuccggcuacgagaccuuccgcgucaucggcggcuggaacaccgccaacuccaagucccagaccucccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115059 - RNA, 1401 nt, Artificial Sequence
  derived and/or modified sequence opt2 from neuraminidase__InfluenzaA__AGQ81758
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucguccccugcgagcccaccaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacgagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacgacucccgcuccggcuacgagaccuuccgcgucgucaacggcuggaccauggccaacuccaagucccagaucaaccgccaggucaucgucgacuccgacaacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115060 - RNA, 1401 nt, Artificial Sequence
  derived and/or modified sequence opt2 from neuraminidase__InfluenzaA__AGQ81759
augaaccccaaccagaagaucaucgccaucggcuccgucucccucaccaucgccaucaucugcuuccucauccagaucgccauccucaccaccaccaugacccuccacuuccgccaguccgagugcuccaaccccuccaacaaccaggucguccccugcgagcccaucaucaucgagcgcaacaccguccaccucaacuccaccaucaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucaucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccgcgagacccgcgucugguggaccuccaacuccaucaucgucuucugcggcaccuccggcaccuacggcaccggcuccuggcccgacggcgccaacaucaacuucaugcccaucuga

SEQ ID NO: 115061 - RNA, 1401 nt, Artificial Sequence
  derived and/or modified sequence opt2 from neuraminidase__InfluenzaA__AGQ81760
augaaccccaaccagaagaucaucgccaucggcuccgucucccucaccaucgccaucaucugcuuccucaugcagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaucaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 115062 - RNA, 1401 nt, Artificial Sequence
  derived and/or modified sequence opt2 from neuraminidase__InfluenzaA__AGQ81761
augaaccccaaccagaagaucaucgccaucggcuccgucucccucaccaucgccaucaucugcuuccucaugcagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucaucaaggagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 115063 - RNA, 1401 nt, Artificial Sequence
  derived and/or modified sequence opt2 from neuraminidase__InfluenzaA__AGQ81763
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacaacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115064 - RNA, 1401 nt, Artificial Sequence
  derived and/or modified sequence opt2 from neuraminidase__InfluenzaA__AGQ81766
augaaccccaaccagaagaucaucgccaucggcuccgucucccucaccaucgccaucaucugcuuccucaugcagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuucuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagaccaucgucugguggaccuccaacuccaucaucgucuucugcggcaccuccggcaccuacggcaccggcuccuggcccgacggcgccaacaucaacuucaugcccaucuga

SEQ ID NO: 115065 - RNA, 1401 nt, Artificial Sequence; identical to SEQ ID NO: 115064
  derived and/or modified sequence opt2 from neuraminidase__InfluenzaA__AGQ81767

SEQ ID NO: 115066 - RNA, 1410 nt, Artificial Sequence
  derived and/or modified sequence opt2 from neuraminidase__InfluenzaA__AGQ81768
augaaccccaaccagaagaucgucgccaucggcuccgucucccucaccaucgccaccaucugccuccucaugcagaucgccauccucgucaccaccaugacccuccacuucaagcacggcgagugcaccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucauguccgagcucggcguccccuuccaccucgccaccaagcaggucugcaucgccugguccuccuccuccugccacgacggcgaggccuggcuccacaucugcgucaccggcgacgaccgcaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggaccuccgcuccggcuacgagaccuuccgcgucaucggcggcuggaacaccgccaacuccaagucccagaccaaccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115067 - RNA, 1410 nt, Artificial Sequence
  derived and/or modified sequence opt2 from neuraminidase__InfluenzaA__AGQ81769
augaaccccaaccagaagaucgucgccaucggcuccgucucccucaccaucgccaccaucugccuccucaugcagaucgccauccucgucaccaccaugacccuccacuucaagcacggcgagugcaccaacuccuccaacaaccaggccguccccugcggccccaucaucaucgagcgcaacaucaccgagaucguccaccucaacuccaccacccucgagaaggagaucugccccaaggccgccggcuaccgcgacugguccaagccccagugccagaucaccggcuucgcccccuucuccaaggacaacuccauccgccucuccgccuccggcgacaucugggucacccgcgagcccuacgucuccugcggccucggcaagugcuaccaguucgcccucggccagggcaccacccucgacaaccgccacuccaacggcaccucccacgaccgcaccccccaccgcacccuccucauguccgagcucggcguccccuuccaccucgccaccaagcaggucugcaucgccugguccuccuccuccugccacgacggcgaggccuggcuccacaucugcgucaccggcgacgaccgcaacgccaccgccuccaucaucuacggcggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccgucgacuccggcuacgucugcuccggccucgucggcgacaccccccgcaacgacgacaccuccuccuccuccaacugcaaggaccccaacaacgagcgcggcgcccccggcgucaagggcugggccuucgacuccggcaacgacaucuggaugggccgcaccaucgagaaggaccuccgcuccggcuacgagaccuuccgcgucaucggcggcuggaacaccgccaacuccaagucccagaccaaccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115068 - RNA, 1401 nt, Artificial Sequence
  derived and/or modified sequence opt2 from neuraminidase__InfluenzaA__AGQ81770
augaaccccaaccagaagaucaucgccaucggcuccgucuccaucaccaucgccaucaucugcuucaucaugcagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagaaggagaccugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 115069 - RNA, 1410 nt, Artificial Sequence
  derived and/or modified sequence opt2 from neuraminidase__InfluenzaA__AGQ81772
augaaccccaaccagaagaucgucgccaucggcuccgccucccucaccaucgccaccaugugccuccuccuccagaucgcccucuucgccaccaccaugacccuccacuucaagcagaccggcugcaccaacuccuccgacaaccaggccguccccugcggccccaucaucaucgagcgcaacaucaccgagaucguccaccucaacuccaccacccucgagaaggagaccugccccaaguccgccggcuaccgcaacugguccaagccccagugccagaucaccggcuucgcccccuucuccaaggacaacuccauccgccucgccgccgccggcgacaucugggucacccgcgagcccuacgucuccugcggccucggcaagugcuaccaguucgcccucggccagggcaccacccucgacaacaagcacuccaacggcaccacccacgaccgcaccccccaccgcacccuccucauguccgagcucggcguccccuuccaccucgccaccaagcaggucugcaucgccugguccuccuccuccugccacgacggcaaggccuggcuccacgucugcgucaccggcgacgacaagaacgccaccgccuccaucaucuacgacggcauccucgucgacuccaucgccuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuucaucaacauggccgacuacuccaucgacuccuccuacgucugccccggccucgucggcgacaccccccgcaacgacgaccgcuccuccuccuccaacugccgcgaccccaacaacgagcgcggcgcccccggcgucaagggcugggccuucgacuccggcaacgacaucuggaugggccgcaccaucgagaaggacucccgcuccggcuacgagaccuuccgcgucaucuccggcugguccaccgccaacuccaagucccagaucaaccgccaggucaucgucgaccgcgacaacuccuccggcuacuccggcaucuucuccgucgagggcaaguccugcaucaaccgcugcuucuacgucgagcucauccgcggccgccccaaggagaaccgcgucugguggaccuccaacuccaucaucgucuucugcggcaccuccggcaccuacggcaccggcuccuggcccgacggcgccaacaucaaccucaugcccaucuga

SEQ ID NO: 115070 - RNA, 1401 nt, Artificial Sequence
  derived and/or modified sequence opt2 from neuraminidase__InfluenzaA__AGQ81773
augaaccccaaccagaagaucaucgccaucggcuccgucucccucaccaucgccaucaucugcuuccucaugcagaucgccauccucaccaccaccaugacccuccacuuccgccagaacgagugcuccaaccccuccaacaaccaggucguccccugcgagcccaucaucaucgagcgcaagaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcgucccccuccacuggggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcuggggcuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 115071 - RNA, 1401 nt, Artificial Sequence
  derived and/or modified sequence opt2 from neuraminidase__InfluenzaA__AGQ81774
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccaucgccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115072 - RNA, 1401 nt, Artificial Sequence
  derived and/or modified sequence opt2 from neuraminidase__InfluenzaA__AGQ81776
augaaccccaaccagaagaucaucgccaucggcuccgucucccucaccaucgccaucaucugcuuccucaugcagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucaucgacggcuggaccaccgccgacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 115073 - RNA, 1410 nt, Artificial Sequence
  derived and/or modified sequence opt2 from neuraminidase__InfluenzaA__AGQ81777
augaaccccaaccagaagaucgucaccaucggcuccgccucccucaccaucgccaccaugugccuccuccuccagaucgcccucuucgccaccaccaugacccuccacuucaagcagaccggcugcaccaacuccuccgacaaccaggccguccccugcggccccaucaucaucgagcgcaacaucaccgagaucguccaccucaacuccaccacccucgagaaggagaccugccccaaguccgccggcuaccgcaacugguccaagccccagugccagaucaccggcuucgcccccuucuccaaggacaacuccauccgccucgccgccgccggcgacaucugggucacccgcgagcccuacgucuccugcggccucggcaagugcuaccaguucgcccucggccagggcaccacccucgacaacaagcacuccaacggcaccacccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgacaagaacgccaccgccuccaucaucuacgacggcauccucgucgacuccaucgccuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagguccgcugcgucugccgcgacaacuggaacggcuccaaccgccccguccucuucaucaacauggccgacuacuccaucgacuccuccuacgucugcuccggccucgucggcgacaccccccgcaacgacgaccgcuccuccuccuccaacugccgcgaccccaacaacgagcgcggcgcccccggcgucaagggcugggccuucgacuccggcaacgacaucuggaugggccgcaccaucgagaaggacucccgcuccggcuacgagaccuuccgcgucaucuccggcugguccaccgccaacuccaagucccagaucaaccgccaggucaucgucgaccgcgacaacuccuccggcuacuccggcaucuucuccgucgagggcaaguccugcaucaaccgcugcuucuacgucgagcucauccgcggccgccccaaggagaaccgcgucugguggaccuccaacuccaucaucgucuucugcggcaccuccggcaccuacggcaccggcuccuggcccgacggcgccaacaucaaccucaugcccaucuga

SEQ ID NO: 115074 - RNA, 1410 nt, Artificial Sequence
  derived and/or modified sequence opt2 from neuraminidase__InfluenzaA__AGQ81778
augaaccccaaccagaagaucgucaccaucggcuccgccucccucaccaucgccaccaugugccuccuccuccagaucgcccucuucgccaccaccaugacccuccacuucaagcagaccggcugcaccaacuccuccgacaaccaggccguccccugcggccccaucaucaucgagcgcaacaucaccgagaucguccaccucaacuccaccacccucgagaaggagaccugccccaaguccgccggcuaccgcaacugguccaagccccagugccagaucaccggcuucgcccccuucuccaaggacaacuccauccgccucgccgccgccggcgacaucugggucacccgcgagcccuacgucuccugcggccucggcaagugcuaccaguucgcccucggccagggcaccacccucgacaacaagcacuccaacggcaccacccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgacaagaacgccaccgccuccaucaucuacgacggcauccucgucgacuccaucgccuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuucaucaacauggccgacuacuccaucgacuccuccuacgucugcuccggccucgucggcgacaccccccgcaacgacgaccgcuccuccuccuccaacugccgcgaccccaacaacgagcgcggcgcccccggcgucaagggcugggccuucgacuccggcaacgacaucuggaugggccgcaccaucgagaaggacucccgcuccggcuacgagaccuuccgcgucaucuccggcugguccaccgccaacuccaagucccagaucaaccgccaggucaucgucgaccgcgacaacuccuccggcuacuccggcaucuucuccgucgagggcaaguccugcaucaaccgcugcuucuacgucgagcucauccgcggccgccccaaggagaaccgcgucugguggaccuccaacuccaucaucgucuucugcggcaccuccggcaccuacggcaccggcuccuggcccgacggcgccaacaucaaccucaugcccaucuga

SEQ ID NO: 115075 - RNA, 1410 nt, Artificial Sequence
  derived and/or modified sequence opt2 from neuraminidase__InfluenzaA__AGQ81779
augaaccccaaccagaagaucgucgccaucggcuccgccucccucaccaucgccaccaugugccuccuccuccagaucgcccucuucgccaccaccaugacccuccacuucaagcagaccggcugcaccaacuccuccgacaaccaggccguccccugcggccccaucaucaucgagcgcaacaucaccgagaucguccaccucaacuccaccacccucgagaaggagaccugccccaaguccgccggcuaccgcaacugguccaagccccagugccagaucaccggcuucgcccccuucuccaaggacaacuccauccgccucgccgccgccggcgacaucugggucacccgcgagcccuacgucuccugcggccucggcaagugcuaccaguucgcccucggccagggcaccacccucgacaacaagcacuccaacggcaccacccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgacaagaacgccaccgccuccaucaucuacgacggcauccucgucgacuccaucgccuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagauccgcugcgucugccgcgacaacuggaagggcuccaaccgccccguccucuucaucaacauggccgacuacuccaucgacuccuccuacgucugcuccggccucgucggcgacaccccccgcaacgacgaccgcuccuccuccuccaacugccgcgaccccaacaacgagcgcggcgcccccggcgucaagggcugggccuucgacuccggcaacgacaucuggaugggccgcaccaucgagaaggacucccgcuccggcuacgagaccuuccgcgucaucuccggcugguccaccgccaacuccaagucccagaucaaccgccaggucaucgucgaccgcgacaacuccuccggcuacuccggcaucuucuccgucgagggcaaguccugcaucaaccgcugcuucuacgucgagcucauccgcggccgccccaaggagaaccgcgucugguggaccuccaacuccaucaucgucuucugcggcaccuccggcaccuacggcaccggcuccuggcccgacggcgccaacaucaaccucaugcccaucuga

SEQ ID NO: 115076 - RNA, 1410 nt, Artificial Sequence
  derived and/or modified sequence opt2 from neuraminidase__InfluenzaA__AGQ81780
augaaccccaaccagaagaucgucgccaucggcuccgccucccucaccaucgccaccaugugccuccuccuccagaucgcccucuucgccaccaccaugacccuccacuucaagcagaccggcugcaccaacuccuccgacaaccaggccguccccugcggccccaucaucaucgagcgcaacaucaccgagaucguccaccucaacuccaccacccucgagaaggagaccugccccaaguccgccggcuaccgcaacugguccaagccccagugccagaucaccggcuucgcccccuucuccaaggacaacuccauccgccucgccgccgccggcgacaucugggucacccgcgagcccuacgucuccugcggccucggcaagugcuaccaguucgcccucggccagggcaccacccucgacaacaagcacuccaacggcaccacccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgacaagaacgccaccgccuccaucaucuacgacggcauccucgucgacuccaucgccuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuucaucaacauggccgacuacuccaucgacuccuccuacgucugcuccggccucgucggcgacaccccccgcaacgacgaccgcuccuccuccuccaacugccgcgaccccaacaacgagcgcggcgccuccggcgucaagggcugggccuucgacuccggcaacgacaucuggaugggccgcaccaucgagaaggacucccgcuccggcuacgagaccuuccgcgucaucuccggcugguccaccgccaacuccaagucccagaucaaccgccaggucaucgucgaccgcgacaacuccuccggcuacuccggcaucuucuccgucgagggcaaguccugcaucaaccgcugcuucuacgucgagcucauccgcggccgccccaaggagaaccgcgucugguggaccuccaacuccaucaucgucuucugcggcaccuccggcaccuacggcaccggcuccuggcccgacggcgccaacaucaaccucaugcccaucuga

SEQ ID NO: 115077 - RNA, 1401 nt, Artificial Sequence
  derived and/or modified sequence opt2 from neuraminidase__InfluenzaA__AGQ81781
augaaccccaaccagaagaucaucgccaucggcuccgucucccucaccaucgccaucaucugcuuccucaugcagaucgccauccucaccaccaccaugaccccccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccgacaucaaccucaugcccaucuga

SEQ ID NO: 115078 - RNA, 1410 nt, Artificial Sequence
  derived and/or modified sequence opt2 from neuraminidase__InfluenzaA__AGQ81783
augaaccccaaccagaagaucgucaccaucggcuccgccucccucaccaucgccaccaugugccuccuccuccagaucgcccucuucgccaccaccaugacccuccacuucaagcagaccggcugcaccaacuccuccgacaaccaggccguccccugcggccccaucaucaucgagcgcaacaucaccgagaucguccaccucaacuccaccacccucgagaaggagaccugccccaaguccgccggcuaccgcaacugguccaagccccagugccagaucaccggcuucgcccccuucuccaaggacaacuccauccgccucgccgccgccggcgacaucugggucacccgcgagcccuacgucuccugcggccucggcaagugcuaccaguucgcccucggccagggcaccacccucgacaacaagcacuccaacggcaccacccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgacaagaacgccaccgccuccaucaucuacaacggcauccucgucgacuccaucgccuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuucaucaacauggccgacuacuccaucgacuccuccuacgucugcuccggccucgucggcgacaccccccgcaacgacgaccgcuccuccuccuccaacugccgcgaccccaacaacgagcgcggcgcccccggcgucaagggcugggccuucgacuccggcaacgacaucuggaugggccgcaccaucgagaaggacucccgcuccggcuacgagaccuuccgcgucaucuccggcugguccaccgccaacuccaagucccagaucaaccgccaggucaucgucgaccgcgacaacuccuccggcuacuccggcaucuucuccgucgagggcaaguccugcaucaaccgcugcuucuacgucgagcucauccgcggccgccccaaggagaaccgcgucugguggaccuccaacuccaucaucgucuucugcggcaccuccggcaccuacggcaccggcuccuggcccgacggcgccaacaucaaccucaugcccaucuga

SEQ ID NO: 115079 - RNA, 1401 nt, Artificial Sequence
  derived and/or modified sequence opt2 from neuraminidase__InfluenzaA__AGQ81784
augaaccccaaccagaagaucaucgccaucggcuccgucucccucaccaucgccaucaucugcuuccucaugcagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccuccgcaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcaacgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccgacaucaacuucaugcccaucuga

SEQ ID NO: 115080 - RNA, 1401 nt, Artificial Sequence
  derived and/or modified sequence opt2 from neuraminidase__InfluenzaA__AGQ81785
augaaccccaaccagaagaucaucgccaucggcuccgucucccucaccaucgccaucaucugcuucaucaugcagaucgccauccucaccaccaccaugaccccccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccgacaucaaccucaugcccaucuga

SEQ ID NO: 115081 - RNA, 1401 nt, Artificial Sequence
  derived and/or modified sequence opt2 from neuraminidase__InfluenzaA__AGQ81787
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115082 - RNA, 1401 nt, Artificial Sequence
  derived and/or modified sequence opt2 from neuraminidase__InfluenzaA__AGQ81789
augaaccccaaccagaagaucaucgccaucggcuccgucucccucaccaucgccaucaucugccuccucaugcagaucgccauccucaccaccaccaugaccccccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccgacaucaaccucaugcccaucuga

SEQ ID NO: 115083 - RNA, 1401 nt, Artificial Sequence
  derived and/or modified sequence opt2 from neuraminidase__InfluenzaA__AGQ81790
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggccaugcccugcgagcccaucaucaucgagcgcaacaccguccaccucaacuccaccaccaucgagcgcgagaucugccccaaggucaccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggccgcgccgacacccgcguccucuucauccgcgagggcaagaucaucaacaucuccccccucuccggcaacgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgagugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115084 - RNA, 1401 nt, Artificial Sequence
  derived and/or modified sequence opt2 from neuraminidase__InfluenzaA__AGQ81792
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucaacaagugcuaccaguucgcccucggccagggcaccacccucgagaacaagcacuccaacggcaccacccacgaccgcaccccccaccgcacccuccucaugaacgagcucggcguccccuuccaccucggcaccaagcaggucugcauggccugguccuccuccuccugcuacgacggcaaggccuggcuccacaucugcgucaccggcgacgacaagaacgccaccgccuccgucaucuacgacggcaugcucgucgacuccaucggcuccuggucccagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115085 - RNA, 1401 nt, Artificial Sequence
  derived and/or modified sequence opt2 from neuraminidase__InfluenzaA__AGQ81793
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucaacaagugcuaccaguucgcccucggccagggcaccacccucgagaacaagcacuccaacggcaccacccacgaccgcaccccccaccgcacccuccucaugaacgagcucggcguccccuuccaccucggcaccaagcaggucugcauggccugguccuccuccuccugcuacgacggcaaggccuggcuccacaucugcgucaccggcgacgacaagaacgccaccgccuccgucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115086 - RNA, 1401 nt, Artificial Sequence; identical to SEQ ID NO: 115085
  derived and/or modified sequence opt2 from neuraminidase__InfluenzaA__AGQ81794

SEQ ID NO: 115087 - RNA, 1401 nt, Artificial Sequence
  derived and/or modified sequence opt2 from neuraminidase__InfluenzaA__AGQ81795
augaaccccaaccagaagaucaucgccaucggcuccgucucccucaucaucgccaucaucugccuccucaugcagaucgccauccucaccaccaccaugacccuccacuuccgccagaacgagugcaacaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccaucgccaacuccaagucccagaucaaccgccagaucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115088 - RNA, 1401 nt, Artificial Sequence
  derived and/or modified sequence opt2 from neuraminidase__InfluenzaA__AGQ81796
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacaucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115089 - RNA, 1401 nt, Artificial Sequence
  derived and/or modified sequence opt2 from neuraminidase__InfluenzaA__AGQ81798
augaaccccaaccagaagaucaucuccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115090 - RNA, 1401 nt, Artificial Sequence
  derived and/or modified sequence opt2 from neuraminidase__InfluenzaA__AGQ81799
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115091 - RNA, 1401 nt, Artificial Sequence; identical to SEQ ID NO: 115090
  derived and/or modified sequence opt2 from neuraminidase__InfluenzaA__AGQ81800

SEQ ID NO: 115092 - RNA, 1401 nt, Artificial Sequence
  derived and/or modified sequence opt2 from neuraminidase__InfluenzaA__AGQ81801
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccuccggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115093 - RNA, 1401 nt, Artificial Sequence
  derived and/or modified sequence opt2 from neuraminidase__InfluenzaA__AGQ81802
augaaccccaaccagaagaucaucgccaucggcuccgucucccucaucaucgccaucaucugccuccucaugcagaucgcccuccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacaacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcgagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115094 - RNA, 1401 nt, Artificial Sequence
  derived and/or modified sequence opt2 from neuraminidase__InfluenzaA__AGQ81803
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccuccggcgacaucugggucacccgcgagcccuacgucuccugcucccucgacaagugcuaccaguucgcccucggccagggcaccacccucaagaacgagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaucauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115095 - RNA, 1410 nt, Artificial Sequence
  derived and/or modified sequence opt2 from neuraminidase__InfluenzaA__AGQ81804
augaaccccaaccagaagaugaucgccaucggcgccgucucccucaccaucgccaucaucugccuccucaugcagaccgccauccucgucaccaccaugacccuccacuucaagcacaacgagugcaccaacuccuccaacaaccaggccgcccccugcggccccaucaucaucgagcgcaacgucaccgaggucguccaccucaacuccaccacccucgagaaggagaucugccccaaggccgccggcuaccgcaacugguccaagccccagugccagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccucccacgaccgcaccccccaccgcacccuccucaugaacgagcucggcguccccuuccaccucaugaccaagcaggucugcaucgccugguccuccuccuccugccacgacggcaaggccuggcuccacgucugcgucaccggcgacgaccgcaacgccaccgccuccaucaucuacggcggcauccucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucguccacaucuccccccucuccggcuccgcccagcacgucgaggagugcuccugcuacccccaguaccccgagguccgcugcgucugccgcgacaacuggcgcggcuccaaccgccccguccucuacaucaacauggccgacuacuccaucgacuccggcuacgucugcuccggccucgucggcgacaccccccgcaacgacgacgucuccuccuccuccaacugcaaggaccccaacaacgagcgcggcgcccccggcgucaagggcugggccuucgacaacggcaacgacaucuggaugggccgcaccaucgacaaggacucccgcuccggcuacgagaccuuccgcgucaucgacggcuggaacaccgccaacuccaagucccagaccucccgccaggucaucgucggcuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 115096 - RNA, 1401 nt, Artificial Sequence
  derived and/or modified sequence opt2 from neuraminidase__InfluenzaA__AGQ81805
augaaccccaaccagaagaucaucgccaucggcuccgucucccucaucaucgccaucaucugccuccucaugcagaucgcccuccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccaccaugaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcggccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115097 - RNA, 1401 nt, Artificial Sequence
  derived and/or modified sequence opt2 from neuraminidase__InfluenzaA__AGQ81807
augaaccccaaccagaagaucaccgccaucggcuccaucucccucaucaucgccaucaucugccuccucaugcagaucgccauccucaccaccaccaugacccuccacuuccgccagaacgagugccgcaaccccuccaacaaccaggucaugcccugcgagcccgucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccuccggcgacaucugggucacccgcgagcccuacgucuccugcucccucaacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucaucaaggagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaucauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115098 - RNA, 1401 nt, Artificial Sequence
  derived and/or modified sequence opt2 from neuraminidase__InfluenzaA__AGQ81808
augaaccccaaccagaagaucaucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaaccacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccauccgcaacaacucccgcuccggcuacgagaccuuccgcgucgucaacggcuggaccaccgccaacuccaagucccagaucaaccgccagaucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115099 - RNA, 1401 nt, Artificial Sequence
  derived and/or modified sequence opt2 from neuraminidase__InfluenzaA__AGQ81809
augaaccccaaccagaagaucaccgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccccgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcgaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccaucaucuacaucaacauggucgacuacuccaucggcucccgcuacgucugcuccggccucgucggcgacaccccccgcaacgacgacuccaccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucaucaacggcuggaccauggccaacuccaagucccagaucaaccgccaggucaucgucgacuccgacaacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccgacaucaacuucaugcccaucuga

SEQ ID NO: 115100 - RNA, 1401 nt, Artificial Sequence
  derived and/or modified sequence opt2 from neuraminidase__InfluenzaA__AGQ81810
augaaccccaaccagaagauccucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaaccacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccauccgcaacaacucccgcuccggcuacgagaccuuccgcgucgucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115101 - RNA, 1401 nt, Artificial Sequence
  derived and/or modified sequence opt2 from neuraminidase__InfluenzaA__AGQ81811
augaaccccaaccagaagaucaucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucgucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuucuccuccuccaacugccgcgaccccaacaacgagcgcggcgcccccggcgucaagggcugggccuucgacgacggcaacgacgucuggaugggccgcaccauccgcaacgacucccgcuccggcuacgagaccuuccgcgucgucaacggcuggaccaccgccaacuccaagucccagaucaaccgccaggucaucgucgacuccgaguccugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115102 - RNA, 1410 nt, Artificial Sequence
  derived and/or modified sequence opt2 from neuraminidase__InfluenzaA__AGQ81812
augaaccccaaccagaagaucaucaccaucggcuccgucucccucaccaucgccaccaucugcuuccucaugcagaucgccauccucgucaccaccaucacccuccacuucaagcagaacgagugcuccauccccuccaacaaccaggucguccccugcgagcccaucaucgucgagcgcaacaucaccgagaucgucuaccucaacaacaccaccaucgagaaggagcucugccccaagcucaccgaguaccgcgacugguccaagccccagugccagaucaccggcuucgcccccuucuccaaggacaacuccauccgccucuccgccggcggcgacaucugggucacccgcgagcccuacgucuccugcucccccaacaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcaucgccugguccuccuccuccugccacgacggcaaggccuggcuccacgucugcgucaccggcgacgaccgcaacgccaccgccuccuucaucuacgacggcaugcucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacgucuccccccucuccggcuccgcccagcacaucgaggagugcuccugcuacccccgcuaccccgacguccgcugcgucugccgcgacaacuggaagggcuccaaccgccccaucaucgacaucaacgucgccgacuacuccaucgacuccuccuacgucugcuccggccucgucggcgacaccccccgcaacgacgacuccuccuccaacuccaacugcaaggaccccaacaacgagcgcggcaaccccggcgucaagggcugggccuucgacuacggcaacgacgucuggaugggccgcaccaucuccaaggacucccgcuccggcuacgagaccuuccgcgucaucggcggcuggaccaccgccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 115103 - RNA, 1401 nt, Artificial Sequence
  derived and/or modified sequence opt2 from neuraminidase__InfluenzaA__AGQ81814
augaaccccaaccagaagaucaucgccaucggcuccgucucccucaccaucgccaucaugugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaaccacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccauccgcaacaacucccgcuccggcuacgagaccuuccgcgucgucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115104 - RNA, 1401 nt, Artificial Sequence
  derived and/or modified sequence opt2 from neuraminidase__InfluenzaA__AGQ81815
augaaccccaaccagaagaucaucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcacccccggcgucaagggcugggccuucgacgacggcaacgacgucuggaugggccgcaccauccgcaacgacucccgcuccggcuacgagaccuuccgcgucaucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuacaugcccaucuga

SEQ ID NO: 115105 - RNA, 1401 nt, Artificial Sequence
  derived and/or modified sequence opt2 from neuraminidase__InfluenzaA__AGQ81816
augaaccccaaccagaagaucaucgccaucggcuccgucucccucaccaucgccaucaucugcuuccucaugcagaucgccauccucaccaccaccaugacccuccacuucaagcagaacggcugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcacccccggcgucaagggcugggccuucgacgacggcaacgacgucuggaugggccgcaccauccgcaacgacucccgcuccggcuacgagaccuuccgcgucaucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuacaugcccaucuga

SEQ ID NO: 115106 - RNA, 1401 nt, Artificial Sequence; identical to SEQ ID NO: 115104
  derived and/or modified sequence opt2 from neuraminidase__InfluenzaA__AGQ81817

SEQ ID NO: 115107 - RNA, 1401 nt, Artificial Sequence; identical to SEQ ID NO: 115104
  derived and/or modified sequence opt2 from neuraminidase__InfluenzaA__AGQ81818

SEQ ID NO: 115108 - RNA, 1401 nt, Artificial Sequence; identical to SEQ ID NO: 115104
  derived and/or modified sequence opt2 from neuraminidase__InfluenzaA__AGQ81819

SEQ ID NO: 115109 - RNA, 1401 nt, Artificial Sequence
  derived and/or modified sequence opt2 from neuraminidase__InfluenzaA__AGQ81820
augaaccccaaccagaagaucaucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcaacgacgacuccuccuccuccuccaacugccgcgaccccaacaacgagcgcggcacccccggcgucaagggcugggccuucgacgacggcaacgacgucuggaugggccgcaccauccgcaacgacucccgcuccggcuacgagaccuuccgcgucaucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagcccaaggucugguggaccuccaacuccaucaucgucuucugcggcaccuccggcaccuacggcaccggcuccuggcccgacggcgccaacaucaacuucaugcccaucuga

SEQ ID NO: 115110 - RNA, 1401 nt, Artificial Sequence
  derived and/or modified sequence opt2 from neuraminidase__InfluenzaA__AGQ81822
augaaccccaaccagaagaucaucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaagaaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcacccccggcgucaagggcugggccuucgacgacggcaacgacgucuggaugggccgcaccauccgcaacgacucccgcuccggcuacgagaccuuccgcgucaucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuacaugcccaucuga

SEQ ID NO: 115111 - RNA, 1401 nt, Artificial Sequence
  derived and/or modified sequence opt2 from neuraminidase__InfluenzaA__AGQ81823
augaaccccaaccagaagaucaucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccauccgcaacgacucccgcuccggcuacgagaccuuccgcgucgucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115112 - RNA, 1401 nt, Artificial Sequence; identical to SEQ ID NO: 115111
  derived and/or modified sequence opt2 from neuraminidase__InfluenzaA__AGQ81824

SEQ ID NO: 115113 - RNA, 1401 nt, Artificial Sequence; identical to SEQ ID NO: 115111
  derived and/or modified sequence opt2 from neuraminidase__InfluenzaA__AGQ81825

SEQ ID NO: 115114 - RNA, 1401 nt, Artificial Sequence
  derived and/or modified sequence opt2 from neuraminidase__InfluenzaA__AGQ81831
augaaccccaaccagaagauccucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucgucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuucuccuccuccaacugccgcgaccccaacaacgagcgcggcgcccccggcgucaagggcugggccuucgacgacggcaacgacgucuggaugggccgcaccauccgcaacgacucccgcuccggcuacgagaccuuccgcgucgucaacggcuggaccaccgccaacuccaagucccagaucaaccgccaggucaucgucgacuccgaguccugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115115 - RNA, 1401 nt, Artificial Sequence; identical to SEQ ID NO: 115104
  derived and/or modified sequence opt2 from neuraminidase__InfluenzaA__AGQ81837

SEQ ID NO: 115116 - RNA, 1401 nt, Artificial Sequence; identical to SEQ ID NO: 115104
  derived and/or modified sequence opt2 from neuraminidase__InfluenzaA__AGQ81838

SEQ ID NO: 115117 - RNA, 1401 nt, Artificial Sequence; identical to SEQ ID NO: 115111
  derived and/or modified sequence opt2 from neuraminidase__InfluenzaA__AGQ81839

SEQ ID NO: 115118 - RNA, 1401 nt, Artificial Sequence; identical to SEQ ID NO: 115111
  derived and/or modified sequence opt2 from neuraminidase__InfluenzaA__AGQ81840

SEQ ID NO: 115119 - RNA, 1401 nt, Artificial Sequence; identical to SEQ ID NO: 115104
  derived and/or modified sequence opt2 from neuraminidase__InfluenzaA__AGQ81841

SEQ ID NO: 115120 - RNA, 1410 nt, Artificial Sequence
  derived and/or modified sequence opt2 from neuraminidase__InfluenzaA__AGQ81843
augaaccccaaccagaagaucaucaccaucggcgucgucaacaccacccucuccaccaucgcccuccucaucggcaucggcaaccucaucuucaacaccgucauccacgagaagaucggcguccaccagaccgucgucuaccccaccaucaccccccccgucauccccaacugcuccgacaccaccaucaccuacaacaacaccgucgucaacaacaucaccaccaccaucaucaacaaggccgagaagcaguucaagcccucccucccccucugccccuuccgcggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacgucugcaugaccggcaacgacaacgacgccuccggccagaucaucuacgccggcaagaugaccgacuccaucaaguccuggcgccgcgacauccuccgcacccaggaguccgagugccagugcaucgacggcaccugcaucgucgccgucaccgacggccccgccgccuccuccgccgaccaccgcaucuacuggauccgcgagggcaagaucaucaaguacgaggacauccccaagaccaagauccagcaccucgaggagugcuccugcuacgucgacaccgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacaucaacggcggccccggcgucaagggcuucggcuuccgcgccggcaacgacgucuggcucggccgcaccgucuccaccaccggccgcuccggcuucgaggucaucaaggucaccgagggcuggaucaacucccucaaccacgccaaguccgucacccagacccucgucuccaacaacgacugguccggcuacuccggcuccuucaucgucgagaacaacggcugcuuccagcccugcuucuacaucgagcucauccgcggccgccccaaccgcaacgacgacgucuccuggaccuccaacuccaucgucaccuucugcggccucgacaacgagcccggcuccggcaacuggcccgacggcuccaacaucggcuucaugcccaaguga

SEQ ID NO: 115121 - RNA, 1410 nt, Artificial Sequence
  derived and/or modified sequence opt2 from neuraminidase__InfluenzaA__AGQ81845
augaaccccaaccagaagaucaucaccaucggcgucgucaacaccacccucuccaccaucgcccuccucaucggcaucggcaaccucaucuucaacaccgucauccacgagaagaucggcguccaccagaccgucaucuaccccaccaucaccucccccgucguccccaacugcuccgacaccaccaucaccuacaacaacaccgucgucaacaacaucaccaccaccgucaucaacaaggccgagaagcacuucaagcccucccucccccucugccccuucaagggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacgucugcaugaccggcaacgacaacgacgccuccggccagaucaucuacgccggcaagaugaccgacuccaucaaguccuggcgccgcgacauccuccgcacccaggaguccgagugccagugcaucgacggcaccugcaucgucgccgucaccgacggccccgccgccaacuccgccgaccaccgcaucuacuggauccgcgagggcaagaucaucaaguacgagaacauccccaagaccaagauccagcaccucgaggagugcuccugcuacgucgacaccgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacaucaacggcggccccggcgucaagggcuucggcuuccgcaccggcaacgacgucuggcucggccgcaccgucuccaccaccggccgcuccggcuucgaggucaucaaggucaccgagggcuggaucaacucccucaaccacgccaaguccgucacccagacccucgucuccaacuccgacugguccggcuacuccggcuccuucaucgucgagaacaacggcugcuuccagcccugcuucuacaucgagcucauccgcggccgccccaacaagaacgacgacgucuccuggaccuccaacuccaucgucaccuucugcggccucgacaacgagcccggcuccggcaacuggcccgacggcuccaacaucggcuucaugcccaaguga

SEQ ID NO: 115122 - RNA, 1410 nt, Artificial Sequence; identical to SEQ ID NO: 115121
  derived and/or modified sequence opt2 from neuraminidase__InfluenzaA__AGQ81846

SEQ ID NO: 115123 - RNA, 1410 nt, Artificial Sequence; identical to SEQ ID NO: 115121
  derived and/or modified sequence opt2 from neuraminidase__InfluenzaA__AGQ81847

SEQ ID NO: 115124 - RNA, 1410 nt, Artificial Sequence
  derived and/or modified sequence opt2 from neuraminidase__InfluenzaA__AGQ81848
augaaccccaaccagaagaucaucaccaucggcgucgucaacaccacccucuccaccaucgcccuccucaucggcaucggcaaccucaucuucaacaccgucauccacgagaagaucggcguccaccagaccgucaucuaccccaccaucaccucccccgucguccccaacugcuccgacaccaccaucaccuacaacaacaccgucgucaacaacaucaccaccaccgucaucaacaaggccgagaagcacuucaagcccucccucccccucugccccuucaagggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacgucugcaugaccggcaacgacaacgacgccuccggccagaucaucuacgccggcaagaugaccgacuccaucaaguccuggcgccgcgacauccuccgcacccaggaguccgagugccagugcaucgacggcaucugcaucgucgccgucaccgacggccccgccgccaacuccgccgaccaccgcaucuacuggauccgcgagggcaagaucaucaaguacgagaacauccccaagaccaagauccagcaccucgaggagugcuccugcuacgucgacaccgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacaucaacggcggccccggcgucaagggcuucggcuuccgcaccggcaacgacgucuggcucggccgcaccgucuccaccaccggccgcuccggcuucgaggucaucaaggucaccgagggcuggaucaacucccucaaccacgccaaguccgucacccagacccucgucuccaacuccgacugguccggcuacuccggcuccuucaucgucgagaacaacggcugcuuccagcccugcuucuacaucgagcucauccgcggccgccccaacaagaacgacgacgucuccuggaccuccaacuccaucgucaccuucugcggccucgacaacgagcccggcuccggcaacuggcccgacggcuccaacaucggcuucaugcccaaguga

SEQ ID NO: 115125 - RNA, 1410 nt, Artificial Sequence
  derived and/or modified sequence opt2 from neuraminidase__InfluenzaA__AGQ81850
augaaccccaaccagaagaucaucaccaucggcgucgucaacaccacccucuccaccaucgcccuccucaucggcaucggcaaccucaucuucaacaccgucauccacgagaagaucggcguccaccagaccgucaucuaccccaccaucaccucccccgucguccccaacugcuccgacaccaccaucaccuacaacaacaccgucgucaacaacaucaccaccaccgucaucaacaaggccgagaagcacuucaagcccucccucccccucugccccuucaagggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacgucugcaugaccggcaacgacaacgacgccaccggccagaucaucuacgccggcaagaugaccgacuccaucaaguccuggcgccgcgacauccuccgcacccaggaguccgagugccagugcaucgacggcaccugcaucgucgccgucaccgacggccccgccgccaacuccgccgaccaccgcaucuacuggauccgcgagggcaagaucaucaaguacgagaacauccccaagaccaagauccagcaccucgaggagugcuccugcuacgucgacaccgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacaucaacggcggccccggcgucaagggcuucggcuuccgcaccggcaacgacgucuggcucggccgcaccgucuccaccaccggccgcuccggcuucgaggucaucaaggucaccgagggcuggaucaacucccucaaccacgccaaguccgucacccagacccucgucuccaacuccgacugguccggcuacuccggcuccuucaucgucgagaacaacggcugcuuccagcccugcuucuacaucgagcucauccgcggccgccccaacaagaacgacgacgucuccuggaccuccaacuccaucgucaccuucugcggccucgacaacgagcccggcuccggcaacuggcccgacggcuccaacaucggcuucaugcccaaguga

SEQ ID NO: 115126 - RNA, 1410 nt, Artificial Sequence
  derived and/or modified sequence opt2 from neuraminidase__InfluenzaA__AGQ81852
augaaccccaaccagaagaucaucaccaucggcgucgucaacaccacccucuccaccaucgcccuccucaucggcaucggcaaccucaucuucaacaccgucauccacgagaagaucggcguccaccagaccgucaccuaccccaccaucaccucccccgucguccccaacugcuccgacaccaccaucaccuacaacaacaccgucgucaacaacaucaccaccaccgucaucaacaaggccgagaagcacuucaagcccucccucccccucugccccuucaagggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacgucugcaugaccggcaacgacaacgacgccaccggccagaucaucuacgccggcaagaugaccgacuccaucaaguccuggcgccgcgacauccuccgcacccaggaguccgagugccagugcaucgacggcaccugcaucgucgccgucaccgacggccccgccgccaacuccgccgaccaccgcaucuacuggauccgcgagggcaagaucaucaaguacgagaacauccccaagaccaagauccagcaccucgaggagugcuccugcuacgucgacaccgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacaucaacggcggccccggcgucaagggcuucggcuuccgcaccggcaacgacgucuggcucggccgcaccgucuccaccaccggccgcuccggcuucgaggucaucaaggucaccgagggcuggaucaacucccucaaccacgccaaguccgucacccagacccucgucuccaacuccgacugguccggcuacuccggcuccuucaucgucgagaacaacggcugcuuccagcccugcuucuacaucgagcucauccgcggccgccccaaccgcaacgacgacgucuccuggaccuccaacuccaucgucaccuucugcggccucgacaacgagcccggcuccggcaacuggcccgacggcuccaacaucggcuucaugcccaaguga

SEQ ID NO: 115127 - RNA, 1410 nt, Artificial Sequence
  derived and/or modified sequence opt2 from neuraminidase__InfluenzaA__AGQ81853
augaaccccaaccagaagaucaucaccaucggcgucgucaacaccacccucuccaccaucgcccuccucaucggcaucggcaaccucaucuucaacaccgucauccacgagaagaucggcguccaccagaccgucaccuaccccaccaucaccucccccgucguccccaacugcuccgacaccaccaucaccuacaacaacaccgucgucaacaacaucaccaccaccgucaucaacaaggccgagaagcacuucaagcccucccucccccucugccccuucaagggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacgucugcaugaccggcaacgacaacgacgccaccggccagaucaucuacgccggcaagaugaccgacuccaucaaguccuggcgccgcgacauccuccgcacccaggaguccgagugccagugcaucgacggcaccugcaucgucgccgucaccgacggccccgccgccaacuccgccgaccaccgcaucuacuggauccgcgagggcaagaucaucaaguacgagaacauccccaagaccaagauccagcaccucgaggagugcuccugcuacgucgacaccgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacaucaacggcggccccggcgucaagggcuucggcuuccgcaccggcaacgacgucuggcucggccgcaccgucuccaccaccggccgcuccggcuucgaggucaucaaggucaccgagggcuggaucaacucccucaaccacgccaaguccgucacccagacccucgucuccaacuccgacugguccggcuacuccggcuccuucaucgucgagaacaacggcugcuuccagcccugcuucuacaucgagcucauccgcggccgccccaacaagaacgacgacgucuccuggaccuccaacuccaucgucaccuucugcggccucgacaacgagcccggcuccggcaacuggcccgacggcuccaacaucggcuucaugcccaaguga

SEQ ID NO: 115128 - RNA, 1410 nt, Artificial Sequence; identical to SEQ ID NO: 115127
  derived and/or modified sequence opt2 from neuraminidase__InfluenzaA__AGQ81854

SEQ ID NO: 115129 - RNA, 1410 nt, Artificial Sequence; identical to SEQ ID NO: 115127
  derived and/or modified sequence opt2 from neuraminidase__InfluenzaA__AGQ81855

SEQ ID NO: 115130 - RNA, 1410 nt, Artificial Sequence; identical to SEQ ID NO: 115120
  derived and/or modified sequence opt2 from neuraminidase__InfluenzaA__AGQ81856

SEQ ID NO: 115131 - RNA, 1410 nt, Artificial Sequence
  derived and/or modified sequence opt2 from neuraminidase__InfluenzaA__AGQ81857
augaaccccaaccagaagaucaucaccaucggcgucgucaacaccacccucuccaccaucgcccuccucaucggcaucggcaaccucaucuucaacaccgucauccacgagaagaucggcguccaccagaccgucgucuaccccaccaucaccccccccgucauccccaacugcuccgacaccaccaucaccuacaacaacaccgucgucaacaacaucaccaccaccaucaucaacaaggccgagaagcaguucaagcccucccucccccucugccccuuccgcggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacgucugcaugaccggcaacgacaacgacgccuccggccagaucaucuacgccggcaagaugaccgacuccaucaaguccuggcgccgcgacauccuccgcacccaggaguccgagugccagugcaucgacggcaccugcaucgucgccgucaccgacggccccgccgccuccuccgccgaccaccgcaucuacuggauccgcgagggcaagaucaucaaguacgaggacauccccaagaccaagauccagcaccucgaggagugcuccugcuacgucgacaccgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacaucaacggcggccccggcgucaagggcuucggcuuccgcgccggcaacgacgucuggcucggccgcaccgucuccaccaccggccgcuccggcuucgaggucaucaaggucaccgagggcuggaucaacucccucaaccacgccaaguccgucacccagacccucgucuccaacaacgacugguccggcuacuccggcuccuucaucgucgaguccaacggcugcuuccagcccugcuucuacaucgagcucauccgcggccgccccaaccgcaacgacgacgucuccuggaccuccaacuccaucgucaccuucugcggccucgacaacgagcccggcuccggcaacuggcccgacggcuccaacaucggcuucaugcccaaguga

SEQ ID NO: 115132 - RNA, 1410 nt, Artificial Sequence
  derived and/or modified sequence opt2 from neuraminidase__InfluenzaA__AGQ81858
augaaccccaaccagaagaucaucaccaucggcgucgucaacaccacccucuccaccaucgcccuccucaucggcgucggcaaccucaucuucaacaccgucauccacgagaagaucggcgaccaccagaucgucgucuaccccaccaccaccgccuccgucguccccaacugcuccgacaccaucaucaccuacaacaacaccgucgucaacaacaucaccaccaccaucaucaccaaggaggagacccacuucaaguccucccucccccucugccccuuccgcggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacgucugcaugaccggcaacgacaacgacgccuccggccagaucauguacgccggcaagaugaccgacuccaucaaguccuggcgcaaggacauccuccgcacccaggaguccgagugccagugcaucgacggcaccugcaucgucgccgucaccgacggccccgccaccaacuccgccgaccaccgcaucuacuggauccgcgagggcaagaucaucaaguacgagaacauccccaagaccaagauccagcaccucgaggagugcuccugcuacgucgacaucgacgucuacugcgucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacgucaacggcggccccggcgucaagggcuucggcuucaagaccggcaacgacgucuggcucggccgcaccgucuccaccuccggccgcuccggcuucgagaucaucaaggucaccgagggcuggaucaacucccccaaccacgccaaguccgucacccagacccucgucuccaacaacgacugguccggcuacuccggcuccuucaucgucgagaacaacggcugcuuccagcccugcuucuacaucgagcucauccgcggccgccccaacaagaacgacgacgucuccuggaccuccaacuccaucgucaccuucugcggccucgacaacgagcccggcuccggcaacuggcccgacggcuccaacaucggcuucaugcccaaguga

SEQ ID NO: 115133 - RNA, 1410 nt, Artificial Sequence
  derived and/or modified sequence opt2 from neuraminidase__InfluenzaA__AGQ81859
augaaccccaaccagaagaucaucaccaucggcgucgucaacaccacccucuccaccaucgcccuccucaucggcaucggcaaccucaucuucaacaccgucauccacgagaagaucggcguccaccagaccgucgucugccccaccaucaccccccccgucguccccaacugcuccgacaccaccaucaccuacaacaacaccgucgucaacaacaucaccaccaccaucaucaacaaggccgagaagcaguucaaguccucccucccccucugccccuuccgcggcuucuuccccuuccacaaggacaacgccauccgccucggcgagaacaaggacgucaucgucacccgcgagcccuacgucuccugcgacaacgacgacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcgucgccugguccuccuccuccugcuucgacggcaaggaguggaugcacaucugcaugaccggcaacgacaacgacgccuccggccagaucaucuacgccggcaagaugaccgacuccaucaaguccuggcgccgcgacauccuccgcacccaggaguccgagugccagugcaucgacggcaccugcaucgucgccaucaccgacggccccgccgccuccuccgccgaccaccgcaucuacuggauccgcgagggcaagaucaucaaguacgagaacauccccaagaccaagauccagcaccucgaggagugcuccugcuacgucgacaucgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaccgucuccugcgacucccccuccaacaucaacggcggccccggcgucaagggcuucggcuuccgcgccggcaacgacgucuggcucggccgcaccgucuccaccaccggccgcuccggcuucgaggucaucaaggucaccgagggcuggaucaacucccucaaccacgccaaguccgucacccagacccucgucuccaacuccgacugguccggcuacuccggcuccuucaucgucgagaacaacggcugcuuccagcccugcuucuacaucgagcucauccgcggccgccccaaccgcaacgacgacgucuccuggaccuccaacuccaucgucaccuucugcggccucgacaacgagcccggcuccggcaacuggcccgacggcuccaacaucggcuucaugcccaaguga

SEQ ID NO: 115134 - RNA, 1413 nt, Artificial Sequence
  derived and/or modified sequence opt2 from neuraminidase__InfluenzaA__AGQ81860
augaaccccaaccagaagaucaucugcaucuccgccaccggcaugacccucuccgucgucucccuccucaucggcaucgccaaccucggccucaacaucggccuccacuacaaggucggcgacacccccgacgucuccauccccaacaugaacgagaccaacuccaccaccaccaucaucaacaacaacacccagaacaacuucaccaacaucaccaacaucaucgucaacaagaacgaggagaagaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucgucuccugggagaugggccaggcccccucccccuacaacgucaaggucgagugcgucggcugguccuccaccuccugccacgacggcaucucccgcauguccaucugcauguccggccccaacaacaacgccuccgccgucgucugguacggcggccgccccgucaccgagauccccuccugggccggcaacauccuccgcacccaggaguccgagugcgucugccacaagggcaucugccccgucgucaugaccgacggccccgccaacaaccgcgccgccaccaagaucaucuacuucaaggagggcaagauccagaagaucgaggagcucgccggcuccgcccagcacaucgaggagugcuccugcuacggcgccgucgaggucaucaagugcaucugccgcgacaacuggaagggcgccaaccgccccgucaucaccaucaaccccgagaugaugacccacaccuccaaguaccucugcuccaagguccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccucccaccaggucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcuccaaggagcgccucggcuccugguccuggcacgacggcgccgagaucaucuacuucaaguga

SEQ ID NO: 115135 - RNA, 1413 nt, Artificial Sequence
  derived and/or modified sequence opt2 from neuraminidase__InfluenzaA__AGQ81861
augaaccccaaccagaagaucaucugcaucuccgccaccggcaugacccucuccgucgucucccuccucaucggcaucgccaaccucggccucaacaucggccuccacuacaaggucggcgacacccccgacgucuccauccccaacaugaacgagaccaacuccaccaccaccaucaucaacaacaacacccagaacaacuucaccaacaccaccaacaucaucgucaacaagaacgaggagaagaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucgucuccugggagaugggccaggcccccucccccuacaacgucaaggucgagugcgucggcugguccuccaccuccugccacgacggcaucucccgcauguccaucugcauguccggccccaacaacaacgccuccgccgucgucugguacggcggccgccccgucaccgagauccccuccugggccggcaacauccuccgcacccaggaguccgagugcgucugccacaagggcaucugccccgucgucaugaccgacggccccgccaacaaccgcgccgccaccaagaucaucuacuucaaggagggcaagauccagaagaucgaggagcucgccggcuccgcccagcacaucgaggagugcuccugcuacggcgccgucgaggucaucaagugcaucugccgcgacaacuggaagggcgccaaccgccccgucaucaccaucaaccccgagaugaugacccacaccuccaaguaccucugcuccaagguccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccucccaccaggucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcuccaaggagcgccucggcuccugguccuggcacgacggcgccgagaucaucuacuucaaguga

SEQ ID NO: 115136 - RNA, 1413 nt, Artificial Sequence
  derived and/or modified sequence opt2 from neuraminidase__InfluenzaA__AGQ81862
augaaccccaaccagaagaucaucugcaucuccgccaccggcaugacccucuccgucgucucccuccucaucggcaucgccaaccucggccucaacaucggccuccacuacaaggucggcgacacccccgacgucaacauccccuccaugaacgagaccaacuccaccaccaccaucaucaacaacaacacccagaacaacuucaccaacaucaccaacaucaucgucaacaaggaggagggccgcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucgucuccugggagaugggccaggcccccucccccuacaacguccgcgucgagugcaucggcugguccuccaccuccugccacgacggcaucucccgcauguccaucugcauguccggccccaacaacaacgccuccgccgucgucugguacggcggccgccccgucaccgagauccccuccugggccggcaacauccuccgcacccaggaguccgagugcgucugccacaagggcaucugccccgucgucaugaccgacggccccgccaacaaccgcgccgccaccaagaucaucuacuucaaggagggcaagauccagaagaucgaggagcucgagggcaacgcccagcacaucgaggagugcuccugcuacggcgccgccggcgucaucaagugcaucugccgcgacaacuggaagggcgccaaccgccccgucaucaucaucgaccccgagaugaugacccacaccuccaaguaccucugcucccgcguccucaccgacaccucccgccccaacgaccccaccuccggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccucccaccaggucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcuccaaggagcgccucggcuccugguccuggcacgacggcgccgagaucaucuacuucaaguga

SEQ ID NO: 115137 - RNA, 1413 nt, Artificial Sequence
  derived and/or modified sequence opt2 from neuraminidase__InfluenzaA__AGQ81863
augaaccccaaccagaagaucaucugcaucuccgccaccggcaugacccucuccgucgucucccuccucaucggcaucgccaaccucggccucaacaucggccuccacuacaaggucggcgacacccccgacgucaacauccccuccaugaacgagaccaacuccaccaccaccaucaucaacaacaacacccagaacaacuucaccaacaucaccaacaucaucgucaacaaggaggaggagcgcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucgucuccugggagaugggccaggcccccucccccuacaacguccgcgucgagugcaucggcugguccuccaccuccugccacgacggcaucucccgcauguccaucugcauguccggccccaacaacaacgccuccgccgucgucugguacggcggccgccccgucaccgagauccccuccugggccggcaacauccuccgcacccaggaguccgagugcgucugccacaagggcaucugccccgucgucaugaccgacggccccgccaacaaccgcgccgccaccaagaucaucuacuucaaggagggcaagauccagaagaucgaggagcucgagggcaacgcccagcacaucgaggagugcuccugcuacggcgccgccggcgucaucaagugcaucugccgcgacaacuggaagggcgccaaccgccccgucaucaucaucgaccccgagaugaugacccacaccuccaaguaccucugcucccgcguccucaccgacaccucccgccccaacgaccccaucuccggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccucccaccaggucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcuccaaggagcgccucggcuccugguccuggcacgacggcgccgagaucaucuacuucaaguga

SEQ ID NO: 115138 - RNA, 1416 nt, Artificial Sequence
  derived and/or modified sequence opt2 from neuraminidase__InfluenzaA__AGQ81864
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaccaccaucaaccagaacaacaccaccaucgucgagaacaccuacgucaacaacaccaccaucaucuccaaggagaccgagcucaagccccccaacuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggccuacaccaaggucauguacuuccacaagggccucgucaucaaggaggaggcccucaagggcuccgcccgccacaucgaggagugcuccugcuacggccacucccagaaggccaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucucccccaagucccgcuccggcuucgagaugcucaagauccccaacgccggcaccgaccccaacucccgcaucgccgagcgccaggagaucgucgacaacaacaacugguccggcuacuccggcuccuucaucgacuacugggacaacgacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115139 - RNA, 1416 nt, Artificial Sequence
  derived and/or modified sequence opt2 from neuraminidase__InfluenzaA__AGQ81865
augaaccccaaccagaagcucuucgcccucuccggcgucgccaucgcccucuccguccucaaccuccucaucggccucuccaacgucggccucaacgucucccuccaccucaaggagaccggccccaagcaggagggcaaccucaccugcaugaccaucaaccagaacaacaccaccgucgucgagaacaccuacgucaacaacaccaccaucaucaccaaggagaccgaguccgagacccccaacuaccuccuccucaacaagucccucugcaacgucgagggcugggucgucaucgccaaggacaacgccguccgcuucggcgaguccgagcagaucaucgucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucgucaaggaggaggcccucaagggcuccgcccgccacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcggcaacaccuggcucggccgcaccaucuccccccgcucccgcuccggcuucgagaugcucaagauccccaacgccggcaccgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115140 - RNA, 1416 nt, Artificial Sequence
  derived and/or modified sequence opt2 from neuraminidase__InfluenzaA__AGQ81868
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaccaccaucaaccagaacaacaccaccgucgucgagaacaccuacgucaacaacaccaccaucaucaccaaggagaccgagcucaagacccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccucccucggcaccccccccaccaucuccaacuccgacuucaugugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaucugcgccgucgucaugaccgacggcuccgccuccucccaggccuacaccaaggucauguacuuccacaagggccucgucgucaaggaggaggcccucaagggcuccgcccgccacaucgaggagugcuccugcuacggccacucccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucgccggcucccccggcgcccccggcgucaagggcuucggcuuccucaacggcgacaacaccuggcucggccgcaccaucuccccccgcucccgcuccggcuucgagaugcucaagauccccaacgccggcaccgaccccaacucccgcaucgccggccgccaggagaucgucgacaacaacaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115141 - RNA, 1416 nt, Artificial Sequence
  derived and/or modified sequence opt2 from neuraminidase__InfluenzaA__AGQ81869
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaccaccaucaaccagaacaacaccaccaucgucgagaacaccuacgucaacaacaccaccaucaucuccaaggagaccgagcucaagacccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccauccgcaccugggcccgcaacauccuccgcacccaggaguccgagugcgucugccacaacggcaccugcgccgucgucaugaccgacggcuccgccuccucccaggccuacaccaaggucauguacuuccacaagggccucgucaucaaggaggaggcccucaagggcuccgcccgccacaucgaggagugcuccugcuacggccacucccagaaggccaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaccgaccccaacucccgcaucgccgagcgccaggagaucgucgacaacaacaacugguccggcuacuccggcuccuucaucgacuacuggaacaacgacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115142 - RNA, 1416 nt, Artificial Sequence
  derived and/or modified sequence opt2 from neuraminidase__InfluenzaA__AGQ81870
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaccaccaucaaccagaacaacaccaccaucgucgagaacaccuacgucaacaacaccaccaucaucuccaaggagaccgagcucaagccccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccauccgcaccugggcccgcaacauccuccgcacccaggaguccgagugcgucugccacaacggcaccugcgccgucgucaugaccgacggcuccgccuccucccaggccuacaccaaggucauguacuuccacaagggccucgucaucaaggaggaggcccucaagggcuccgcccgccacaucgaggagugcuccugcuacggccacucccagaaggccaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaccgaccccaacucccgcaucgccgagcgccaggagaucgucgacaacaacaacugguccggcuacuccggcuccuucaucgacuacuggaacaacgacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115143 - RNA, 1416 nt, Artificial Sequence
  derived and/or modified sequence opt2 from neuraminidase__InfluenzaA__AGQ81871
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaccaccaucaaccagaacaacaccaccaucgucgagaacaccuacgucaacaacaccaccaucaucuccaaggagaccgagcucaagacccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcaucggcugguccuccaccaccugccacgacggcaucggccgcaugaccaucugcauccagggcaacaacgacaacgccaccgccaccgucuacuacaaccgccgccucaccaccaccauccgcaccugggcccgcaacauccuccgcacccaggaguccgagugcgucugccacaacggcaccugcgccgucgucaugaccgacggcuccgccuccucccaggccuacaccaaggucauguacuuccacaagggccucgucaucaaggaggaggcccucaagggcuccgcccgccacaucgaggagugcuccugcuacggccacucccagaaggccaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaccgaccccaacucccgcaucgccgagcgccaggagaucgucgacaacaacaacugguccggcuacuccggcuccuucaucgacuacuggaacaacgacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115144 - RNA, 1416 nt, Artificial Sequence
  derived and/or modified sequence opt2 from neuraminidase__InfluenzaA__AGQ81872
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaccaccaucaaccagaacaacaccaccaucgucgagaacaccuacgucaacaacaccaccaucaucuccaaggagaccgagcucaagacccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccuccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccauccgcaccugggcccgcaacauccuccgcacccaggaguccgagugcgucugccacaacggcaccugcgccgucgucaugaccgacggcuccgccuccucccaggccuacaccaaggucauguacuuccacaagggccucgucaucaaggaggaggcccucaagggcuccgcccgccacaucgaggagugcuccugcuacggccacucccagaaggccaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaccgaccccaacucccgcaucgccgagcgccaggagaucgucgacaacaacaacugguccggcuacuccggcuccuucaucgacuacuggaacaacgacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115145 - RNA, 1416 nt, Artificial Sequence
  derived and/or modified sequence opt2 from neuraminidase__InfluenzaA__AGQ81875
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaugaccaucaaccagaacaacaccaccgucgucgagaacaccuacgucaacaacaccaccaucaucaccaaggagaccgagcucgagacccccuccuaccuccuccucaacaagggccucugcaacgucgagggcugggucgucaucgccaaggacaacgccguccgcuucggcgagaccgagcagaucaucgucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucaucuacuuccacaagggccucaucgucaaggaggaggcccucaagggcuccgcccgccacaucgaggagugcuccugcuacggccacucccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaaguccaccggcgacugcuccaaccccaucaccggcucccccggcgcccccggcgucaagggcuucggcuaccucaacggcgacaacaccuggcucggccgcaccaucuccccccgcucccgcuccggcuucgagaugcucaagauccccaacgccggcaccgaccccaacucccgcaucaccgagcgccaggagaucgucgacaacaacaacugguccggcuacuccggcuccuucgucgacuacuggaacgacaacuccgagugcuacaaccccugcuucuacgucgagcucauccgcggccgccccgaggaggccaaguacgucugguggaccuccaacuccaucaucgcccucugcggcucccccuuccccgucggcuccggcuccuuccccgacggcgcccagauccaguacuucuccuga

SEQ ID NO: 115146 - RNA, 1416 nt, Artificial Sequence
  derived and/or modified sequence opt2 from neuraminidase__InfluenzaA__AGQ81876
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaugaccaucaaccagaacaacaccaccgucgucgagaacaccuacgucaacaacaccaccaucaucaccaaggagaccgagcucgagacccccuccuaccuccuccucaacaagggccucugcaacgucgagggcugggucgucaucgccaaggacaacgccguccgcuucggcgagaccgagcagaucaucgucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcgacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucaucuacuuccacaagggccucaucgucaaggaggaggcccucaagggcuccgcccgccacaucgaggagugcuccugcuacggccacucccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaaguccaccggcgacugcuccaaccccaucaccggcucccccggcgcccccggcgucaagggcuucggcuaccucaacggcgacaacaccuggcucggccgcaccaucuccccccgcucccgcuccggcuucgagaugcucaagauccccaacgccggcaccgaccccaacucccgcaucaccgagcgccaggagaucgucgacaacaacaacugguccggcuacuccggcuccuucgucgacuacuggaacgacaacuccgagugcuacaaccccugcuucuacgucgagcucauccgcggccgccccgaggaggccaaguacgucugguggaccuccaacuccaucaucgcccucugcggcucccccuuccccgucggcuccggcuccuuccccgacggcgcccagauccaguacuucuccuga

SEQ ID NO: 115147 - RNA, 1416 nt, Artificial Sequence
  derived and/or modified sequence opt2 from neuraminidase__InfluenzaA__AGQ81877
augaaccccaaccagaagcucuucgcccucuccggcgucgccaucgcccucuccguccucaaccuccucaucggcaucuccaacgucggccucaacgucucccuccaccucaaggagaagggccccaagcaggaggagaacuccaccugcaccaccaucaaccagaacaacaccaccgucgucgagaacaccuacgucaacaacaccaccaucaucaccaaggagaccgagcucaagacccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccucccucggcaccccccccaccaucuccaacuccgacuucaugugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaucugcgccgucgucaugaccgacggcuccgccuccucccaggccuacaccaaggucauguacuuccacaagggccucgucgucaaggaggaggcccucaagggcuccgcccgccacaucgaggagugcuccugcuacggccacucccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaccgaccccaacucccgcaucgccggccgccaggagaucgucgacaacaacaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115148 - RNA, 1416 nt, Artificial Sequence
  derived and/or modified sequence opt2 from neuraminidase__InfluenzaA__AGQ81878
augaaccccaaccagaagcucuucgcccucuccggcgucgccaucgcccucuccguccucaaccuccucaucggcaucuccaacgucggccucaacgucucccuccaccucaaggagaagggccccaagcaggaggagaaccucaccugcaccaccaucaaccagaacaacaccaccgucgucgagaacaccuacgucaacaacaccaccaucaucaccaaggagaccgaccucaaggcccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaugugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggccuacaccaaggucauguacuuccacaagggccucgucgucaaggaggaggcccucaagggcuccgcccgccacaucgaggagugcuccugcuacggccacucccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaccgaccccaacucccgcaucgccgagcgccaggagaucgucgacaacaacaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccaucggcuccggcuccuuccccgacggcgcccagauccaguacuucuccuga

SEQ ID NO: 115149 - RNA, 1416 nt, Artificial Sequence
  derived and/or modified sequence opt2 from neuraminidase__InfluenzaA__AGQ81882
augaaccccaaccagaagcucuucgcccucuccggcgucgccaucgcccucuccguccucaaccuccucaucggcaucuccaacgucggccucaacgucucccuccaccucaaggagaagggcgccaagcaggaggagaaccucaccugcaccaccaucaaccagaacaacaccaccgucgucgagaacaccuacgucaacaacaccaccgucaucaccaaggaggccgacuggaagacccccuccuaccuccuccucaacaagucccucugcaacgucgagggcugggucgucaucgccaaggacaacgccauccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaugugcgucggcugguccuccaccaccugccacgacggcaucggccgcaugaccaucugcauccagggcaacaacgacaacgccaccgccaccgucuacuacaacggccgccucaccaccaccaucaagaccugggcccgcaacauccuccgcacccaggaguccgagugcgucugccacaacggcaccugcgccgucgucaugaccgacggcuccgccuccucccaggccuacaccaaggucauguacuuccacaagggccucgucaucaaggaggaggcccucaagggcuccgcccgccacaucgaggagugcuccugcuacggccacucccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacaacaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115150 - RNA, 1416 nt, Artificial Sequence
  derived and/or modified sequence opt2 from neuraminidase__InfluenzaA__AGQ81883
augaaccccaaccagaagcucuucgcccucuccggcgucgccaucgcccucuccguccucaaccuccucaucggcaucuccaacgucggccucaacgucucccuccaccucaaggagaagggccccaagcaggaggagaaccucaccugcaccaccaucaaccagaacaacaccaccgucgucgagaacaccuacgucaacaacaccaccgucaucaccaaggaggccgacuggaagacccccuccuaccuccuccucaacaagucccucugcaacgucgagggcugggucgucaucgccaaggacaacgccauccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaugugcgucggcugguccuccaccaccugccacgacggcaucggccgcaugaccaucugcauccagggcaacaacgacaacgccaccgccaccgucuacuacaacggccgccucaccaccaccaucaagaccugggcccgcaacauccuccgcacccaggaguccgagugcgucugccacaacggcaccugcgccgucgucaugaccgacggcuccgccuccucccaggccuacaccaaggucauguacuuccacaagggccucgucaucaaggaggaggcccucaagggcuccgcccgccacaucgaggagugcuccugcuacggccacucccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacaacaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115151 - RNA, 1416 nt, Artificial Sequence; identical to SEQ ID NO: 115150
  derived and/or modified sequence opt2 from neuraminidase__InfluenzaA__AGQ81884

SEQ ID NO: 115152 - RNA, 1416 nt, Artificial Sequence; identical to SEQ ID NO: 115150
  derived and/or modified sequence opt2 from neuraminidase__InfluenzaA__AGQ81885

SEQ ID NO: 115153 - RNA, 1416 nt, Artificial Sequence; identical to SEQ ID NO: 115150
  derived and/or modified sequence opt2 from neuraminidase__InfluenzaA__AGQ81886

SEQ ID NO: 115154 - RNA, 1356 nt, Artificial Sequence
  derived and/or modified sequence opt2 from neuraminidase__InfluenzaA__AGQ81888
augaaccccaaccagaagcucuucgcccucuccggcgucgccaucgcccucuccguccucaaccuccucaucggccucuccaacgucggccucaacgucucccuccaccucaaggaggccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115155 - RNA, 1356 nt, Artificial Sequence
  derived and/or modified sequence opt2 from neuraminidase__InfluenzaA__AGQ81889
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115156 - RNA, 1356 nt, Artificial Sequence; identical to SEQ ID NO: 115155
  derived and/or modified sequence opt2 from neuraminidase__InfluenzaA__AGQ81890

SEQ ID NO: 115157 - RNA, 1356 nt, Artificial Sequence; identical to SEQ ID NO: 115155
  derived and/or modified sequence opt2 from neuraminidase__InfluenzaA__AGQ81891

SEQ ID NO: 115158 - RNA, 1356 nt, Artificial Sequence
  derived and/or modified sequence opt2 from neuraminidase__InfluenzaA__AGQ81893
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccgaguacgucugguggaccuccaacucccucaucgcccucugcggcucccccuuccccgucggcuccggcuccuuccccgacggcgcccagauccaguacuucuccuga

SEQ ID NO: 115159 - RNA, 1356 nt, Artificial Sequence; identical to SEQ ID NO: 115155
  derived and/or modified sequence opt2 from neuraminidase__InfluenzaA__AGQ81894

SEQ ID NO: 115160 - RNA, 1356 nt, Artificial Sequence; identical to SEQ ID NO: 115155
  derived and/or modified sequence opt2 from neuraminidase__InfluenzaA__AGQ81895

SEQ ID NO: 115161 - RNA, 1356 nt, Artificial Sequence; identical to SEQ ID NO: 115155
  derived and/or modified sequence opt2 from neuraminidase__InfluenzaA__AGQ81896

SEQ ID NO: 115162 - RNA, 1356 nt, Artificial Sequence; identical to SEQ ID NO: 115155
  derived and/or modified sequence opt2 from neuraminidase__InfluenzaA__AGQ81897

SEQ ID NO: 115163 - RNA, 1356 nt, Artificial Sequence; identical to SEQ ID NO: 115155
  derived and/or modified sequence opt2 from neuraminidase__InfluenzaA__AGQ81898

SEQ ID NO: 115164 - RNA, 1356 nt, Artificial Sequence; identical to SEQ ID NO: 115155
  derived and/or modified sequence opt2 from neuraminidase__InfluenzaA__AGQ81899

SEQ ID NO: 115165 - RNA, 1356 nt, Artificial Sequence; identical to SEQ ID NO: 115155
  derived and/or modified sequence opt2 from neuraminidase__InfluenzaA__AGQ81900

SEQ ID NO: 115166 - RNA, 1356 nt, Artificial Sequence; identical to SEQ ID NO: 115155
  derived and/or modified sequence opt2 from neuraminidase__InfluenzaA__AGQ81901

SEQ ID NO: 115167 - RNA, 1356 nt, Artificial Sequence; identical to SEQ ID NO: 115155
  derived and/or modified sequence opt2 from neuraminidase__InfluenzaA__AGQ81902

SEQ ID NO: 115168 - RNA, 1356 nt, Artificial Sequence; identical to SEQ ID NO: 115155
  derived and/or modified sequence opt2 from neuraminidase__InfluenzaA__AGQ81903

SEQ ID NO: 115169 - RNA, 1356 nt, Artificial Sequence
  derived and/or modified sequence opt2 from neuraminidase__InfluenzaA__AGQ81904
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucaccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115170 - RNA, 1356 nt, Artificial Sequence; identical to SEQ ID NO: 115155
  derived and/or modified sequence opt2 from neuraminidase__InfluenzaA__AGQ81905

SEQ ID NO: 115171 - RNA, 1356 nt, Artificial Sequence
  derived and/or modified sequence opt2 from neuraminidase__InfluenzaA__AGQ81906
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucgucaaggaggaggcccucaagggcuccgcccgccacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115172 - RNA, 1356 nt, Artificial Sequence; identical to SEQ ID NO: 115155
  derived and/or modified sequence opt2 from neuraminidase__InfluenzaA__AGQ81907

SEQ ID NO: 115173 - RNA, 1356 nt, Artificial Sequence
  derived and/or modified sequence opt2 from neuraminidase__InfluenzaA__AGQ81908
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccaaccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucaccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115174 - RNA, 1356 nt, Artificial Sequence; identical to SEQ ID NO: 115155
  derived and/or modified sequence opt2 from neuraminidase__InfluenzaA__AGQ81909

SEQ ID NO: 115175 - RNA, 1356 nt, Artificial Sequence
  derived and/or modified sequence opt2 from neuraminidase__InfluenzaA__AGQ81910
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccggccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccuccuccuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115176 - RNA, 1356 nt, Artificial Sequence
  derived and/or modified sequence opt2 from neuraminidase__InfluenzaA__AGQ81911
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccggccaggcccacaccaaggucauguacuuccacaagggccucgucgucaaggaggaggcccucaagggcuccgccaagcacaucgaggagugcuccugcuacggccacaaccagaacgucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115177 - RNA, 1356 nt, Artificial Sequence; identical to SEQ ID NO: 115155
  derived and/or modified sequence opt2 from neuraminidase__InfluenzaA__AGQ81912

SEQ ID NO: 115178 - RNA, 1356 nt, Artificial Sequence
  derived and/or modified sequence opt2 from neuraminidase__InfluenzaA__AGQ81913
augaaccccaaccagaagcucuucgcccucuccggcgucgccaucacccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccggccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115179 - RNA, 1356 nt, Artificial Sequence; identical to SEQ ID NO: 115155
  derived and/or modified sequence opt2 from neuraminidase__InfluenzaA__AGQ81914

SEQ ID NO: 115180 - RNA, 1356 nt, Artificial Sequence; identical to SEQ ID NO: 115155
  derived and/or modified sequence opt2 from neuraminidase__InfluenzaA__AGQ81915

SEQ ID NO: 115181 - RNA, 1416 nt, Artificial Sequence
  derived and/or modified sequence opt2 from neuraminidase__InfluenzaA__AGQ81917
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaucaaccagaacaacaccaccgucgucgagaacaccuacgucaacaacaccaccaucaucaccaaggagaccgagcucgagacccccaacuaccuccuccucaacaagucccucugcaacgucgagggcugggucgucgucgccaaggacaacgccguccgcuucggcgaguccgagcagaucaucgucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucaucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115182 - RNA, 1356 nt, Artificial Sequence
  derived and/or modified sequence opt2 from neuraminidase__InfluenzaA__AGQ81918
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagggccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115183 - RNA, 1356 nt, Artificial Sequence; identical to SEQ ID NO: 115155
  derived and/or modified sequence opt2 from neuraminidase__InfluenzaA__AGQ81919

SEQ ID NO: 115184 - RNA, 1356 nt, Artificial Sequence; identical to SEQ ID NO: 115155
  derived and/or modified sequence opt2 from neuraminidase__InfluenzaA__AGQ81920

SEQ ID NO: 115185 - RNA, 1356 nt, Artificial Sequence
  derived and/or modified sequence opt2 from neuraminidase__InfluenzaA__AGQ81921
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccggccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115186 - RNA, 1356 nt, Artificial Sequence; identical to SEQ ID NO: 115155
  derived and/or modified sequence opt2 from neuraminidase__InfluenzaA__AGQ81922

SEQ ID NO: 115187 - RNA, 1356 nt, Artificial Sequence; identical to SEQ ID NO: 115185
  derived and/or modified sequence opt2 from neuraminidase__InfluenzaA__AGQ81923

SEQ ID NO: 115188 - RNA, 1356 nt, Artificial Sequence
  derived and/or modified sequence opt2 from neuraminidase__InfluenzaA__AGQ81924
augaaccccaaccagaagcucuucgcccucuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccaacucccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115189 - RNA, 1356 nt, Artificial Sequence; identical to SEQ ID NO: 115155
  derived and/or modified sequence opt2 from neuraminidase__InfluenzaA__AGQ81925

SEQ ID NO: 115190 - RNA, 1356 nt, Artificial Sequence; identical to SEQ ID NO: 115155
  derived and/or modified sequence opt2 from neuraminidase__InfluenzaA__AGQ81926

SEQ ID NO: 115191 - RNA, 1356 nt, Artificial Sequence; identical to SEQ ID NO: 115155
  derived and/or modified sequence opt2 from neuraminidase__InfluenzaA__AGQ81927

SEQ ID NO: 115192 - RNA, 1356 nt, Artificial Sequence; identical to SEQ ID NO: 115155
  derived and/or modified sequence opt2 from neuraminidase__InfluenzaA__AGQ81928

SEQ ID NO: 115193 - RNA, 1356 nt, Artificial Sequence; identical to SEQ ID NO: 115155
  derived and/or modified sequence opt2 from neuraminidase__InfluenzaA__AGQ81929

SEQ ID NO: 115194 - RNA, 1413 nt, Artificial Sequence
  derived and/or modified sequence opt2 from neuraminidase__InfluenzaA__AGQ81930
augaaccccaaccagaagaucaucaccaucggcuccaucucccucggccucgucgucuucaacguccuccuccacgucgucuccaucaucgucaccguccucguccucggccgcggcggcaacuccggcaucugcaacgagaccgucguccgcgaguacaacgagaccguccgcaucgagaagaucacccaguggcacaacaccuccgucgucgaguacguccccuacugguccgagggcaacuacaugaacaacaccgaggccaucugcgacgucaagggcuucgcccccuucuccaaggacaacggcauccgcaucggcucccgcggccacgucuucgucauccgcgagcccuucgucuccugcucccccaccgagugccgcaccuucuuccucacccagggcucccuccucaacgacaagcacuccaacggcaccgucaaggaccgcucccccuuccgcacccucauguccgucgaggucggccagucccccaacgucuaccaggcccgcuucgaggccgucgccugguccgccaccgccugccacgacggcaagaaguggaugaccaucggcgucaccggccccgacuccaaggccgucgccgucguccacuacggcggcguccccaccgacgucgucaacuccugggccggcgacauccuccgcacccaggaguccuccugcaccugcauccagggcaacugcuacugggucaugaccgacggccccgccaaccgccaggcccaguaccgcaucuacaaggccaaccagggcaagaucgucggccagaccgacaucuccuucaacggcggccacaucgaggagugcuccugcuaccccaacgacggcaaggucgagugcgucugccgcgacaacuggaccggcaccaaccgccccguccucgucaucucccccgaccucuccuaccgcgucggcuaccucugcgccggccuccccuccgacaccccccgcggcgaggacgcccaguucaccggcuccugcaccucccccaugggcaaccagggcuacggcgucaagggcuucggcuuccgccagggcaccgacgucuggaugggccgcaccaucucccgcaccucccgcuccggcuucgagauccuccgcaucaagaacggcuggacccagaccuccaaggagcagguccgcaagcaggucgucgucgacaaccucaacugguccggcuacuccggcuccuucacccuccccgucgagcucuccggcaaggacugccucguccccugcuucugggucgagaugauccgcggcaagcccgaggagaagaccaucuggaccuccuccuccuccaucgucaugugcggcgucgacuacgaggucgccgacugguccuggcacgacggcgccauccuccccuucgacaucgacaagauguga

SEQ ID NO: 115195 - RNA, 1413 nt, Artificial Sequence
  derived and/or modified sequence opt2 from neuraminidase__InfluenzaA__AGQ81931
augaaccccaaccagaagaucaucaccaucggcucccucucccucggccucgucguccucaacauccuccuccacaucaucuccaucaccaucaccguccucgucaucccccgcaacggcaacaccggcuccugcaacgagaccgucauccgcgaguacaacgagaccguccgcaucgagaagaucacccaguggcacaacaccaacaucaucgaguacaucgagaagcccgagaacgaccucuucaugaacaacaccggcccccucugcgacgccaagggcuucgcccccuucuccaaggacaacggcauccgcaucggcuccaagggccacgucuucgucauccgcgagcccuucgucuccugcucccccaccgagugccgcaccuucuuccucacccagggcucccuccucaacgacaagcacuccaacggcaccgucaaggaccgcucccccuaccgcacccucauguccgucgagaucggccagucccccaacgucuaccaggcccgcuucgaggccgucgccugguccgccaccgccugccacgacggcaagaaguggaugaccaucggcgucaccggccccgacgccaaggccgucgccgucguccacuacggcggcauccccaccgacgucaucaacuccugggccggcgacauccuccgcacccaggaguccuccugcaccugcauccagggcgagugcuacugggucaugaccgacggccccgccaaccgccaggcccaguaccgcgccuucaaggccaagcagggcaagaucaucggccagaccgagaucuccuucaacggcggccacaucgaggagugcuccugcuaccccaacgagggcaaggucgagugcgucugccgcgacaacuggaccggcaccaaccgccccguccucgucaucuccuccgaccucuccuaccgcgucggcuaccucugcgccggccuccccuccgacaccccccgcggcgaggacucccaguucaccggcuccugcaccucccccaugggcaaccagggcuacggcgucaagggcuucggcuuccgccagggcaacgacgucuggaugggccgcaccaucucccgcaccucccgcuccggcuucgagauccucaagauccgcaacggcuggauccagaacuccaaggagcagaucaagcgccaggucgucgucgacaacuccaacugguccggcuacuccggcuccuucacccuccccgucgagcucacccgccgcaacugccucguccccugcuucugggucgagaugauccgcggcaagcccgaggagaagaccaucuggaccuccuccuccuccaucgucaugugcggcgucgaccacgagaucgccaacugguccuggcacgacggcgccauccuccccuucgacaucgacaagauguga

SEQ ID NO: 115196 - RNA, 1413 nt, Artificial Sequence
  derived and/or modified sequence opt2 from neuraminidase__InfluenzaA__AGQ81932
augaaccccaaccagaagaucaucaccaucggcuccaucucccucggccucgucgucuucaacguccuccuccacgucgucuccaucaucgucaccguccucauccucggccgcggcggcaacaacggcaucugcaacgagaccgucguccgcgaguacaacgagaccguccgcaucgagaagaucacccaguggcacaacaccuccgucgucgaguacguccccuacuggaacgagggcaccuacaugaacaacaccgaggccaucugcgacgucaagggcuucgcccccuucuccaaggacaacggcauccgcaucggcucccgcggccacgucuucgucauccgcgagcccuucgucuccugcucccccaccgagugccgcaccuucuuccucacccagggcucccuccucaacgacaagcacuccaacggcaccgucaaggaccgcucccccuuccgcacccucauguccgucgaggucggccagucccccaacgucuaccaggcccgcuucgaggccgucgccugguccgccaccgccugccacgacggcaagaaguggaugaccaucggcgucaccggcuccgacuccaaggccgucgccgucguccacuacggcggcguccccaccgacgucgucaacuccugggccggcgacauccuccgcacccaggaguccuccugcaccugcauccagggcaacugcuacugggucaugaccgacggccccgccaaccgccaggcccaguaccgcaucuacaaggccaaccagggcaaggucaucggccagaccgacaucuccuucaacggcggccacaucgaggagugcuccugcuaccccaacgacggcaaggucgagugcgucugccgcgacaacuggaccggcaccaaccgccccguccucgucaucucccccgaccucuccuaccgcgucggcuaccucugcgccggccuccccuccgacaccccccgcggcgaggacgcccaguucaccggcuccugcaccucccccaugggcaaccagggcuacggcgucaagggcuucggcuuccgccagggcaccgacgucuggaugggccgcaccaucucccagaccucccgcuccggcuucgagauccuccgcgucaagaacggcuggacccagaccuccaaggagcagguccgcaagcaggucgucgucgacaaccucaacugguccggcuacuccggcuccuucacccuccccaucgagcucuccggcaaggacugccucguccccugcuucugggucgagaugauccgcggcaagcccgaggagaaguccaucuggaccuccuccuccuccaucgucaugugcggcgucgacuacgaggucgccgacugguccuggcacgacggcgccauccuccccuucgacaucgacaagauguga

SEQ ID NO: 115197 - RNA, 1413 nt, Artificial Sequence
  derived and/or modified sequence opt2 from neuraminidase__InfluenzaA__AGQ81934
augaaccccaaccagaagauccucugcaccuccgccaccgccaucgucaucggcaccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucacccagaucuccaacaccaacauccagauggaggagcgcgccucccgcgacuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggccgcauccucaagugggagucccucaccggcaccgccaagcacaucgaggagugcuccugcuacggcgagcgcaccggcaucaccugcaccugccgcgacaacuggcagggcuccaaccgccccgucauccgcaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccagugggacuggcccgacggcgccaagaucgaguacuuccucuga

SEQ ID NO: 115198 - RNA, 1413 nt, Artificial Sequence; identical to SEQ ID NO: 115197
  derived and/or modified sequence opt2 from neuraminidase__InfluenzaA__AGQ81935

SEQ ID NO: 115199 - RNA, 1413 nt, Artificial Sequence; identical to SEQ ID NO: 115197
  derived and/or modified sequence opt2 from neuraminidase__InfluenzaA__AGQ81936

SEQ ID NO: 115200 - RNA, 1413 nt, Artificial Sequence; identical to SEQ ID NO: 115197
  derived and/or modified sequence opt2 from neuraminidase__InfluenzaA__AGQ81937

SEQ ID NO: 115201 - RNA, 1413 nt, Artificial Sequence; identical to SEQ ID NO: 115197
  derived and/or modified sequence opt2 from neuraminidase__InfluenzaA__AGQ81938

SEQ ID NO: 115202 - RNA, 1413 nt, Artificial Sequence; identical to SEQ ID NO: 115197
  derived and/or modified sequence opt2 from neuraminidase__InfluenzaA__AGQ81939

SEQ ID NO: 115203 - RNA, 1413 nt, Artificial Sequence
  derived and/or modified sequence opt2 from neuraminidase__InfluenzaA__AGQ81940
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucacccagaucuccaacaccaacauccagauggaggagcgcgccuccaagggcuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucgccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115204 - RNA, 1413 nt, Artificial Sequence
  derived and/or modified sequence opt2 from neuraminidase__InfluenzaA__AGQ81941
augaaccccaaccagaagauccucugcaccuccgccaccgccaucaucaucggcaccaucgccguccucaucggcgucgccaaccucggccucaacaucggccuccaccucaagcccggcugcaacugcucccacucccagcccgaggccaccaacaccucccagaccaucaucaacaacuacuacaacgagaccaacaucacccagaucuccaacaccaacauccagauggaggagcgccccaaccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcgucuacuacuuccgcgagggcaagauccucaagugggagucccucaccggcaccgcccgccacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccagugggacuggcccgacggcgccaagaucgaguacuuccucuga

SEQ ID NO: 115205 - RNA, 1413 nt, Artificial Sequence
  derived and/or modified sequence opt2 from neuraminidase__InfluenzaA__AGQ81942
augaaccccaaccagaagauccucugcaccuccgccaccgccaucaucaucggcaccaucgccguccucaucggcgucgccaaccucggccucaacaucggccuccaccucaagcccggcugcaacugcucccacucccagcccgaggccaccaacaccucccagaccaucaucaacaacuacuacaacgagaccaacaucacccagaucuccaacaccaacauccagauggaggagcgccccucccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccaucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcgucuacuacuuccgcgagggcaagauccucaagugggagucccucaccggcaccgcccgccacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucauccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccagugggacuggcccgacggcgccaagaucgaguacuuccucuga

SEQ ID NO: 115206 - RNA, 1413 nt, Artificial Sequence
  derived and/or modified sequence opt2 from neuraminidase__InfluenzaA__AGQ81943
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucacccagaucuccaacaccaacauccagauggaggagcgcaccucccgcggcuucaacaaccucaccaagggccucugcaccaucaacuccuggcacaucuacggcaaggacaacgccauccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggccgcauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115207 - RNA, 1413 nt, Artificial Sequence; identical to SEQ ID NO: 115197
  derived and/or modified sequence opt2 from neuraminidase__InfluenzaA__AGQ81944

SEQ ID NO: 115208 - RNA, 1413 nt, Artificial Sequence
  derived and/or modified sequence opt2 from neuraminidase__InfluenzaA__AGQ81947
augaaccccaaccagaagauccucugcaccuccgccaccgcccucgucaucggcaccaucgccguccucaucggcaucgccaaccucggccucaacaucggccuccaccucaagcccuccugcaacugcucccacucccagcccgaggccaccaacaccucccagaccaucaucaacaacuacuacaacgagaccaacaucacccagaucuccaacaccaacauccagauggaggagcgcgccucccgcuccuucaacaaccucaccaagggccucugcaccaucaacuccuggcacaucuacggcaaggacaacgccauccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115209 - RNA, 1413 nt, Artificial Sequence
  derived and/or modified sequence opt2 from neuraminidase__InfluenzaA__AGQ81948
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucacccagaucuccaacaccaacauccagauggaggagcgcaccucccgcggcuucaacaaccucaccaagggccucugcaccaucaacuccuggcacaucuacggcaaggacaacgccauccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggccgcauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgagugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115210 - RNA, 1413 nt, Artificial Sequence
  derived and/or modified sequence opt2 from neuraminidase__InfluenzaA__AGQ81951
augaaccccaaccagaagauccucugcaccuccgccaccgccaucgucaucggcaccaucgccguccucaucggcgucgccaaccucggccucaacaucggccuccaccucaagcccggcugcaacugcucccagucccagcccgaggccaccaacaccucccagaccaucaucaacaacuacuacaacgagaccaacaucacccagaucuccaacaccaacauccagauggaggagcgcgccaaccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcgucuacuacuuccgcgagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115211 - RNA, 1413 nt, Artificial Sequence
  derived and/or modified sequence opt2 from neuraminidase__InfluenzaA__AGQ81952
augaaccccaaccagaagauccucugcaccuccgccaccgccaucgucaucggcaccaucgccguccucaucggcgucgccaaccucggccucaacaucggccuccaccucaagcccggcugcaacugcucccacucccagcccgaggccaccaacaccucccagaccaucaucaacaacuacuacaacgagaccaacaucacccagaucuccaacaccaacauccagauggaggagcgcgccaaccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcgucuacuacuuccgcgagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115212 - RNA, 1413 nt, Artificial Sequence
  derived and/or modified sequence opt2 from neuraminidase__InfluenzaA__AGQ81954
augaaccccaaccagaagauccucugcaccuccgccaccgccaucgucaucggcaccaucgccguccucaucggcgucgccaaccucggccucaacaucggccuccaccucaagcccuccugcaacugcucccacucccagcccgaggccaccaacaccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcgucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115213 - RNA, 1413 nt, Artificial Sequence
  derived and/or modified sequence opt2 from neuraminidase__InfluenzaA__AGQ81956
augaaccccaaccagaagauccucugcaccuccgccaccgccaucgucaucggcaccaucgccguccucaucggcgucgccaaccucggccucaacaucggccuccaccucaagcccuccugcaacugcucccacucccagcccgaggccaccaacaccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccaucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcgucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115214 - RNA, 1413 nt, Artificial Sequence
  derived and/or modified sequence opt2 from neuraminidase__InfluenzaA__AGQ81957
augaaccccaaccagaagauccucugcaccuccgccaccgccaucgucaucggcaccaucgccguccucaucggcaucgccaaccucggccucaacaucggccuccaccucaagcccuccugcaacugcucccacucccagcccgaggccaccaacaccucccagaucaucaucaacaacuacuacaacgagaccaacaucacccaggucuccaacaccaacauccagauggaggagcgcgccucccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccguccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115215 - RNA, 1413 nt, Artificial Sequence; identical to SEQ ID NO: 115197
  derived and/or modified sequence opt2 from neuraminidase__InfluenzaA__AGQ81958

SEQ ID NO: 115216 - RNA, 1413 nt, Artificial Sequence; identical to SEQ ID NO: 115197
  derived and/or modified sequence opt2 from neuraminidase__InfluenzaA__AGQ81959

SEQ ID NO: 115217 - RNA, 1413 nt, Artificial Sequence
  derived and/or modified sequence opt2 from neuraminidase__InfluenzaA__AGQ81960
augaaccccaaccagaagauccucugcaccuccgccaccgccaucgucaucggcaccaucgccguccucaucggcaucgccaaccucggccucaacaucggccuccaccucaagcccaacugcaacugcucccgcucccagcccgagaccaccaacaccucccagaccaucaucaacaacuacuacaacgagaccaacaucacccagaucuccaacaccaacauccagauggaggagcgcgccucccgcgacuucaacaaccucaccaagggccucugcaccaucaacuccuggcacaucuacggcaaggacaacgccguccgcaucggcgagaacuccgacguccucgucacccgcgagcccuacgucuccugcgaccccaacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccgagaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccagugggacuggcccgacggcgccaagaucgaguacuuccucuga

SEQ ID NO: 115218 - RNA, 1413 nt, Artificial Sequence; identical to SEQ ID NO: 115210
  derived and/or modified sequence opt2 from neuraminidase__InfluenzaA__AGQ81961

SEQ ID NO: 115219 - RNA, 1413 nt, Artificial Sequence; identical to SEQ ID NO: 115210
  derived and/or modified sequence opt2 from neuraminidase__InfluenzaA__AGQ81962

SEQ ID NO: 115220 - RNA, 1413 nt, Artificial Sequence
  derived and/or modified sequence opt2 from neuraminidase__InfluenzaA__AGQ81963
augaaccccaaccagaagauccucugcaccuccgccaccgccaucgucaucggcaccaucgccguccucaucggcaucgccaaccucggccucaacaucggccuccaccucaagcccuccugcaacugcucccacucccagcccgaggagaccaacaccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgagaacuccgacguccucgucacccgcgagcccuacgucuccugcgaccccaacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccgucugcaucuccggccccaacgacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgcccacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacuggaccgagggcgacugcuaccgcgccugcuucuacgucgagcucauccgcggccgccccaaggaggacaaggucugguggaccuccaacuccaucgucuccaugugcuccuccaccgaguuccucggccagugggacuggcccgacggcgccaagaucgaguacuuccucuga

SEQ ID NO: 115221 - RNA, 1413 nt, Artificial Sequence
  derived and/or modified sequence opt2 from neuraminidase__InfluenzaA__AGQ81964
augaaccccaaccagaagauccucugcaccuccgccaccgccaucgucaucggcaccaucgccguccucaucggcaucgccaaccucggccucaacaucggccuccaccucaagcccuccugcaacugcucccacuccaagcccgaggagaccaacgccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaccuccaccaccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115222 - RNA, 1413 nt, Artificial Sequence
  derived and/or modified sequence opt2 from neuraminidase__InfluenzaA__AGQ81966
augaaccccaaccagcgcauccucugcaccuccgccaccgccaucgucaucggcaccaucgccguccucaucggcgucgccaaccucggccucaacaucggccuccaccucaagcccggcugcaacugcucccacucccagcccgaggccaccaacaccucccagaccaucaucaacaacuacuacaacgagaccaacaucacccagaucuccaacaccaacauccagauggaggagcgcgccaaccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcgucuacuacuuccgcgagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115223 - RNA, 1413 nt, Artificial Sequence
  derived and/or modified sequence opt2 from neuraminidase__InfluenzaA__AGQ81967
augaaccccaaccagaagauccucugcaccuccgccaccgccaucgucaucggcaucaucgccguccucaucggcaucgccaaccucggccucaacaucggccuccaccucaagcccuccugcaacugcucccacucccagcccgaggccaccaacgccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgagacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaucaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115224 - RNA, 1413 nt, Artificial Sequence
  derived and/or modified sequence opt2 from neuraminidase__InfluenzaA__AGQ81968
augaaccccaaccagaagauccucugcaccuccgccaccgccaucgucaucggcaucaucgccguccucaucggcaucgccaaccucggccucaacaucggccuccaccucaagcccuccugcaacugcucccacucccagcccgaggccaccaacgccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgagaacuccgacauccucgucacccgcgagcccuacgucuccugcgaccccgacgagugccgcuucuacgcccucucccagggcaccaccauccgcggcaagcacuccaacggcaccauccacgaccgcucccaguaccgcucccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgagacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucaucgacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115225 - RNA, 1413 nt, Artificial Sequence
  derived and/or modified sequence opt2 from neuraminidase__InfluenzaA__AGQ81969
augaaccccaaccagaagauccucugcaccuccgccaccgccaucgucaucggcaucaucgccguccucaucggcaucgccaaccucggccucaacaucggccuccaccucaagcccuccugcaacugcucccacucccagcccgaggagaccaacgccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgagacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacaacaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaucaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115226 - RNA, 1413 nt, Artificial Sequence
  derived and/or modified sequence opt2 from neuraminidase__InfluenzaA__AGQ81970
augaaccccaaccagaagauccucugcaccuccgccaccgccaucgucaucggcaccaucgccguccucaucggcaucgccaaccucggccucaacaucggccuccaccucaagcccuccugcaacugcucccacucccagcccgaggagaccaacgccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaacaagcgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagccccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacgucggcaagugcaacgaccccuaccccggcaacuccaacaacggcgucaagggcuucuccuaccucgacggcgucaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115227 - RNA, 1413 nt, Artificial Sequence
  derived and/or modified sequence opt2 from neuraminidase__InfluenzaA__AGQ81971
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucacccagaucuccaacaccaacauccagauggaggagcgcaccucccgcggcuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacuccucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115228 - RNA, 1413 nt, Artificial Sequence
  derived and/or modified sequence opt2 from neuraminidase__InfluenzaA__AGQ81972
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucacccagaucuccaacaccaacauccagauggaggagcgcgccucccgcggcuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115229 - RNA, 1413 nt, Artificial Sequence
  derived and/or modified sequence opt2 from neuraminidase__InfluenzaA__AGQ81973
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucacccagaucuccaacaccaacauccagauggaggagcgcaccucccgcggcuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacaccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115230 - RNA, 1413 nt, Artificial Sequence; identical to SEQ ID NO: 115210
  derived and/or modified sequence opt2 from neuraminidase__InfluenzaA__AGQ81974

SEQ ID NO: 115231 - RNA, 1398 nt, Artificial Sequence
  derived and/or modified sequence opt2 from neuraminidase__InfluenzaA__AGQ81975
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaaguggcucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccgacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgacggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115232 - RNA, 1398 nt, Artificial Sequence
  derived and/or modified sequence opt2 from neuraminidase__InfluenzaA__AGQ81977
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccgacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgacggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115233 - RNA, 1398 nt, Artificial Sequence
  derived and/or modified sequence opt2 from neuraminidase__InfluenzaA__AGQ81979
augaaccccaaccagaagauccucugcaccuccgccaccgccaucaucaucggcgccaucgccgcccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccgacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgacggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 115234 - RNA, 1398 nt, Artificial Sequence; identical to SEQ ID NO: 115232
  derived and/or modified sequence opt2 from neuraminidase__InfluenzaA__AGQ81980

SEQ ID NO: 115235 - RNA, 1350 nt, Artificial Sequence
  derived and/or modified sequence opt2 from neuraminidase__InfluenzaA__AGQ88501
augaaccccaaccagaagaucgucaccaucggcuccaucugcauggucaucggcaucgucucccucaugcuccagaucggcaacaugaucuccaucugggucucccacuccauccagaccggcaaccagcaccagaccgagcccauccgcaacaccaacuuccucaccgagaacgccgucgccuccgucgcccucuccggcaacuccucccucugccccauccgcggcugggccguccacuccaaggacaacuccauccgcaucggcuccaagggcgacgucuucgucauccgcgagcccuucaucuccugcuccaaccucgagugccgcaccuucuuccucacccagggcgcccuccucaacgacaagcacuccaacggcaccgucaaggaccgcuccccccaccgcacccucauguccugccccaucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcaccugcgucaacggcuccugcuucaccgucaugaccgacggccccuccaacggccaggccuccuacaagaucuucaagaucgagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcgagggcuccugcggccccgucucccccaacggcgccuacggcgucaagggcuucuccuucaaguacggcaacggcgucuggaucggccgcaccaaguccacccacucccgcuccggcuucgagaugaucugggaccccaacggcuggaccggcaccgacuccgaguucuccaugaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 115236 - RNA, 1401 nt, Artificial Sequence; identical to SEQ ID NO: 115114
  derived and/or modified sequence opt2 from neuraminidase__InfluenzaA__AGR33906

SEQ ID NO: 115237 - RNA, 1401 nt, Artificial Sequence
  derived and/or modified sequence opt2 from neuraminidase__InfluenzaA__AGR33908
augaaccccaaccagaagaucaccgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccccgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcgaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccaucaucuacaucaacauggucgacuacuccaucgagucccgcuacgucugcuccggccucgucggcgacaccccccgcaacgacgacuccaccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucaucaacggcuggaccauggccaacuccaagucccagaucaaccgccaggucaucgucgacuccgacaacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccgacaucaacuucaugcccaucuga

SEQ ID NO: 115238 - RNA, 1401 nt, Artificial Sequence
  derived and/or modified sequence opt2 from neuraminidase__InfluenzaA__AGR33910
augaaccccaaccagaagaucaucgccaucggcuccgucucccucaccaucgccaucaucugcuuccucaugcagaucgccauccucaccaccaccaugacccuccacuucaagcagaacgagugcuccaagcccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcuccuucggcaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacauccgcccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccauccgcaacgacucccgcuccggcuacgagaccuuccgcgucgucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115239 - RNA, 1401 nt, Artificial Sequence
  derived and/or modified sequence opt2 from neuraminidase__InfluenzaA__AGR33911
augaaccccaaccagaagaucaucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccauccucaucgagcgcaacaccguccaccucaacuccaccaccaucgagaaggaggucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaaccacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccauccgcaacaacucccgcuccggcuacgagaccuuccgcgucgucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 115240 - RNA, 1356 nt, Artificial Sequence; identical to SEQ ID NO: 115155
  derived and/or modified sequence opt2 from neuraminidase__InfluenzaA__AGR33912

SEQ ID NO: 115241 - RNA, 1356 nt, Artificial Sequence; identical to SEQ ID NO: 115185
  derived and/or modified sequence opt2 from neuraminidase__InfluenzaA__AGR33913

SEQ ID NO: 115242 - RNA, 1356 nt, Artificial Sequence; identical to SEQ ID NO: 115155
  derived and/or modified sequence opt2 from neuraminidase__InfluenzaA__AGR33915

SEQ ID NO: 115243 - RNA, 1356 nt, Artificial Sequence
  derived and/or modified sequence opt2 from neuraminidase__InfluenzaA__AGR33916
augaaccccaaccagaagcucuucgccuccuccggcgucgccaucgcccucuccguccucaaccuccucaucggccucuccaacgucggccucaacgucucccuccaccucaaggagaccggccccaagcaggaggagaaccucaccugcaugaccaccaaggagaccgagcucggcacccccuccuaccuccuccucaacaagucccucugcaacgucgagggcugggucgucaucgccaaggacaacgccguccgcuucggcgaguccgagcagaucaucaucacccgcgagcccuacgucuccugcgaccccaacggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaucugcgucggcugguccuccaccaccugccacgacggcaucggccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggcccacaccaaggucauguacuuccacaagggccucgucgucaaggaggaggcccucaagggcuccgccaagcacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaagcccaccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaucgaccccaacucccgcaucgccgagcgccaggagaucgucgacaacuccaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115244 - RNA, 1356 nt, Artificial Sequence; identical to SEQ ID NO: 115185
  derived and/or modified sequence opt2 from neuraminidase__InfluenzaA__AGR33917

SEQ ID NO: 115245 - RNA, 1356 nt, Artificial Sequence; identical to SEQ ID NO: 115155
  derived and/or modified sequence opt2 from neuraminidase__InfluenzaA__AGR33918

SEQ ID NO: 115246 - RNA, 1398 nt, Artificial Sequence; identical to SEQ ID NO: 115232
  derived and/or modified sequence opt2 from neuraminidase__InfluenzaA__AGR33919

SEQ ID NO: 115247 - RNA, 1413 nt, Artificial Sequence
  derived and/or modified sequence opt2 from neuraminidase__InfluenzaA__AGR45094
augaaccccaaccagaagaucaucaccaucggcuccaucuccauggccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccgacuucuccgucaagcaggacgucguccccaugaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacuccgacaccgccaacugguccuggcccgacgacgccgagcucccccucaccaucgacaaguga

SEQ ID NO: 115248 - RNA, 1413 nt, Artificial Sequence; identical to SEQ ID NO: 110442
  derived and/or modified sequence opt2 from neuraminidase__InfluenzaA__AGR49780

SEQ ID NO: 115249 - RNA, 1410 nt, Artificial Sequence
  derived and/or modified sequence opt2 from neuraminidase__InfluenzaA__AGR49804
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucaccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115250 - RNA, 1413 nt, Artificial Sequence; identical to SEQ ID NO: 110442
  derived and/or modified sequence opt2 from neuraminidase__InfluenzaA__AGR49820

SEQ ID NO: 115251 - RNA, 1410 nt, Artificial Sequence; identical to SEQ ID NO: 107602
  derived and/or modified sequence opt2 from neuraminidase__InfluenzaA__AGR49832

SEQ ID NO: 115252 - RNA, 1413 nt, Artificial Sequence; identical to SEQ ID NO: 110442
  derived and/or modified sequence opt2 from neuraminidase__InfluenzaA__AGR49844

SEQ ID NO: 115253 - RNA, 1413 nt, Artificial Sequence; identical to SEQ ID NO: 110442
  derived and/or modified sequence opt2 from neuraminidase__InfluenzaA__AGR49856

SEQ ID NO: 115254 - RNA, 1413 nt, Artificial Sequence; identical to SEQ ID NO: 110442
  derived and/or modified sequence opt2 from neuraminidase__InfluenzaA__AGR49868

SEQ ID NO: 115255 - RNA, 1410 nt, Artificial Sequence; identical to SEQ ID NO: 108240
  derived and/or modified sequence opt2 from neuraminidase__InfluenzaA__AGR49880

SEQ ID NO: 115256 - RNA, 1410 nt, Artificial Sequence; identical to SEQ ID NO: 109996
  derived and/or modified sequence opt2 from neuraminidase__InfluenzaA__AGR49891

SEQ ID NO: 115257 - RNA, 1410 nt, Artificial Sequence
  derived and/or modified sequence opt2 from neuraminidase__InfluenzaA__AGR49903
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115258 - RNA, 1410 nt, Artificial Sequence; identical to SEQ ID NO: 107602
  derived and/or modified sequence opt2 from neuraminidase__InfluenzaA__AGR49915

SEQ ID NO: 115259 - RNA, 1410 nt, Artificial Sequence; identical to SEQ ID NO: 107602
  derived and/or modified sequence opt2 from neuraminidase__InfluenzaA__AGR49927

SEQ ID NO: 115260 - RNA, 1410 nt, Artificial Sequence
  derived and/or modified sequence opt2 from neuraminidase__InfluenzaA__AGR49939
augaaccccaacaagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115261 - RNA, 1410 nt, Artificial Sequence; identical to SEQ ID NO: 108197
  derived and/or modified sequence opt2 from neuraminidase__InfluenzaA__AGR49951

SEQ ID NO: 115262 - RNA, 1410 nt, Artificial Sequence
  derived and/or modified sequence opt2 from neuraminidase__InfluenzaA__AGR49963
augaaccccaacaagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccaagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115263 - RNA, 1410 nt, Artificial Sequence; identical to SEQ ID NO: 108240
  derived and/or modified sequence opt2 from neuraminidase__InfluenzaA__AGR49975

SEQ ID NO: 115264 - RNA, 1413 nt, Artificial Sequence; identical to SEQ ID NO: 110442
  derived and/or modified sequence opt2 from neuraminidase__InfluenzaA__AGR49986

SEQ ID NO: 115265 - RNA, 1413 nt, Artificial Sequence; identical to SEQ ID NO: 110442
  derived and/or modified sequence opt2 from neuraminidase__InfluenzaA__AGR49998

SEQ ID NO: 115266 - RNA, 1410 nt, Artificial Sequence; identical to SEQ ID NO: 108240
  derived and/or modified sequence opt2 from neuraminidase__InfluenzaA__AGR50010

SEQ ID NO: 115267 - RNA, 1410 nt, Artificial Sequence; identical to SEQ ID NO: 108240
  derived and/or modified sequence opt2 from neuraminidase__InfluenzaA__AGR50021

SEQ ID NO: 115268 - RNA, 1410 nt, Artificial Sequence; identical to SEQ ID NO: 108250
  derived and/or modified sequence opt2 from neuraminidase__InfluenzaA__AGR50032

SEQ ID NO: 115269 - RNA, 1410 nt, Artificial Sequence
  derived and/or modified sequence opt2 from neuraminidase__InfluenzaA__AGR50043
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115270 - RNA, 1410 nt, Artificial Sequence; identical to SEQ ID NO: 108240
  derived and/or modified sequence opt2 from neuraminidase__InfluenzaA__AGR50055

SEQ ID NO: 115271 - RNA, 1410 nt, Artificial Sequence
  derived and/or modified sequence opt2 from neuraminidase__InfluenzaA__AGR50066
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115272 - RNA, 1410 nt, Artificial Sequence; identical to SEQ ID NO: 108240
  derived and/or modified sequence opt2 from neuraminidase__InfluenzaA__AGR50077

SEQ ID NO: 115273 - RNA, 1410 nt, Artificial Sequence; identical to SEQ ID NO: 108240
  derived and/or modified sequence opt2 from neuraminidase__InfluenzaA__AGR50088

SEQ ID NO: 115274 - RNA, 1410 nt, Artificial Sequence; identical to SEQ ID NO: 108240
  derived and/or modified sequence opt2 from neuraminidase__InfluenzaA__AGR50099

SEQ ID NO: 115275 - RNA, 1410 nt, Artificial Sequence; identical to SEQ ID NO: 108240
  derived and/or modified sequence opt2 from neuraminidase__InfluenzaA__AGR50110

SEQ ID NO: 115276 - RNA, 1410 nt, Artificial Sequence
  derived and/or modified sequence opt2 from neuraminidase__InfluenzaA__AGR50121
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccguccccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115277 - RNA, 1410 nt, Artificial Sequence
  derived and/or modified sequence opt2 from neuraminidase__InfluenzaA__AGR50132
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgccaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115278 - RNA, 1410 nt, Artificial Sequence; identical to SEQ ID NO: 108240
  derived and/or modified sequence opt2 from neuraminidase__InfluenzaA__AGR50143

SEQ ID NO: 115279 - RNA, 1410 nt, Artificial Sequence; identical to SEQ ID NO: 108240
  derived and/or modified sequence opt2 from neuraminidase__InfluenzaA__AGR50154

SEQ ID NO: 115280 - RNA, 1413 nt, Artificial Sequence; identical to SEQ ID NO: 110442
  derived and/or modified sequence opt2 from neuraminidase__InfluenzaA__AGR50165

SEQ ID NO: 115281 - RNA, 1410 nt, Artificial Sequence; identical to SEQ ID NO: 108240
  derived and/or modified sequence opt2 from neuraminidase__InfluenzaA__AGR50177

SEQ ID NO: 115282 - RNA, 1410 nt, Artificial Sequence; identical to SEQ ID NO: 108240
  derived and/or modified sequence opt2 from neuraminidase__InfluenzaA__AGR50188

SEQ ID NO: 115283 - RNA, 1410 nt, Artificial Sequence; identical to SEQ ID NO: 108240
  derived and/or modified sequence opt2 from neuraminidase__InfluenzaA__AGR50199

SEQ ID NO: 115284 - RNA, 1410 nt, Artificial Sequence; identical to SEQ ID NO: 108240
  derived and/or modified sequence opt2 from neuraminidase__InfluenzaA__AGR50210

SEQ ID NO: 115285 - RNA, 1410 nt, Artificial Sequence; identical to SEQ ID NO: 108240
  derived and/or modified sequence opt2 from neuraminidase__InfluenzaA__AGR50221

SEQ ID NO: 115286 - RNA, 1410 nt, Artificial Sequence
  derived and/or modified sequence opt2 from neuraminidase__InfluenzaA__AGR50232
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccaacaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115287 - RNA, 1410 nt, Artificial Sequence; identical to SEQ ID NO: 108240
  derived and/or modified sequence opt2 from neuraminidase__InfluenzaA__AGR50243

SEQ ID NO: 115288 - RNA, 1410 nt, Artificial Sequence; identical to SEQ ID NO: 108240
  derived and/or modified sequence opt2 from neuraminidase__InfluenzaA__AGR50254

SEQ ID NO: 115289 - RNA, 1410 nt, Artificial Sequence; identical to SEQ ID NO: 108240
  derived and/or modified sequence opt2 from neuraminidase__InfluenzaA__AGR50265

SEQ ID NO: 115290 - RNA, 1410 nt, Artificial Sequence
  derived and/or modified sequence opt2 from neuraminidase__InfluenzaA__AGR50276
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccgagcaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115291 - RNA, 1410 nt, Artificial Sequence; identical to SEQ ID NO: 108240
  derived and/or modified sequence opt2 from neuraminidase__InfluenzaA__AGR50287

SEQ ID NO: 115292 - RNA, 1410 nt, Artificial Sequence
  derived and/or modified sequence opt2 from neuraminidase__InfluenzaA__AGR50298
augaaccccaaccagaagaucaucaccaucggcuccgucugcaugaccaucggcauggccaaccucauccuccagaucggcaacaccaucuccaucuggaucucccacuccauccagcccggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115293 - RNA, 1410 nt, Artificial Sequence; identical to SEQ ID NO: 108240
  derived and/or modified sequence opt2 from neuraminidase__InfluenzaA__AGR50309

SEQ ID NO: 115294 - RNA, 1410 nt, Artificial Sequence; identical to SEQ ID NO: 108240
  derived and/or modified sequence opt2 from neuraminidase__InfluenzaA__AGR50320

SEQ ID NO: 115295 - RNA, 1410 nt, Artificial Sequence; identical to SEQ ID NO: 108240
  derived and/or modified sequence opt2 from neuraminidase__InfluenzaA__AGR50331

SEQ ID NO: 115296 - RNA, 1410 nt, Artificial Sequence
  derived and/or modified sequence opt2 from neuraminidase__InfluenzaA__AGR50342
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucaucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115297 - RNA, 1410 nt, Artificial Sequence; identical to SEQ ID NO: 108240
  derived and/or modified sequence opt2 from neuraminidase__InfluenzaA__AGR50353

SEQ ID NO: 115298 - RNA, 1413 nt, Artificial Sequence; identical to SEQ ID NO: 110442
  derived and/or modified sequence opt2 from neuraminidase__InfluenzaA__AGR50364

SEQ ID NO: 115299 - RNA, 1410 nt, Artificial Sequence
  derived and/or modified sequence opt2 from neuraminidase__InfluenzaA__AGR55170
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaucaaccgccagaucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115300 - RNA, 1410 nt, Artificial Sequence; identical to SEQ ID NO: 105657
  derived and/or modified sequence opt2 from neuraminidase__InfluenzaA__AGR55180

SEQ ID NO: 115301 - RNA, 1410 nt, Artificial Sequence; identical to SEQ ID NO: 105657
  derived and/or modified sequence opt2 from neuraminidase__InfluenzaA__AGR55181

SEQ ID NO: 115302 - RNA, 1410 nt, Artificial Sequence; identical to SEQ ID NO: 105657
  derived and/or modified sequence opt2 from neuraminidase__InfluenzaA__AGR55183

SEQ ID NO: 115303 - RNA, 1410 nt, Artificial Sequence
  derived and/or modified sequence opt2 from neuraminidase__InfluenzaA__AGR55184
augaaccccaaccagaagaucaucaccaucggcuccgucucccucaccaucgccaccaucugcuuccucaugcagaucgccauccucgucaccaccgucacccuccacuucaagcagcacgagugcaacuccccccccaagaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 115304 - RNA, 1410 nt, Artificial Sequence
  derived and/or modified sequence opt2 from neuraminidase__InfluenzaA__AGR55185
augaaccccaaccagaagaucaucaccaucggcuccgucucccucaccaucgccaccaucugcuuccucaugcagaucgccauccucgucaccaccgucacccuccacuucaagcagcacgagugcaacuccccccccaagaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccucccgcaccuacggcaccggcuccuggcccgacggcgccgacaucaaccucaugcccaucuga

SEQ ID NO: 115305 - RNA, 1410 nt, Artificial Sequence
  derived and/or modified sequence opt2 from neuraminidase__InfluenzaA__AGR55186
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgagcccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 115306 - RNA, 1410 nt, Artificial Sequence; identical to SEQ ID NO: 105657
  derived and/or modified sequence opt2 from neuraminidase__InfluenzaA__AGR55187

SEQ ID NO: 115307 - RNA, 1410 nt, Artificial Sequence; identical to SEQ ID NO: 106226
  derived and/or modified sequence opt2 from neuraminidase__InfluenzaA__AGR55192

SEQ ID NO: 115308 - RNA, 1410 nt, Artificial Sequence
  derived and/or modified sequence opt2 from neuraminidase__InfluenzaA__AGR55195
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgaccacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115309 - RNA, 1410 nt, Artificial Sequence
  derived and/or modified sequence opt2 from neuraminidase__InfluenzaA__AGR55204
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccucccgcaccuacggcaccggcuccuggcccgacggcgccgacaucaaccucaugcccaucuga

SEQ ID NO: 115310 - RNA, 1410 nt, Artificial Sequence
  derived and/or modified sequence opt2 from neuraminidase__InfluenzaA__AGR55218
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115311 - RNA, 1410 nt, Artificial Sequence; identical to SEQ ID NO: 114901
  derived and/or modified sequence opt2 from neuraminidase__InfluenzaA__AGT18726

SEQ ID NO: 115312 - RNA, 1410 nt, Artificial Sequence
  derived and/or modified sequence opt2 from neuraminidase__InfluenzaA__AGT18727
augaaccccaaccagaagaucaucaccaucggcuccgucugcaugaccaucggcauggccaaccucauccuccagaucggcaacaucaucuccaucuggaucucccacuccauccagcucggcucccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcugguccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115313 - RNA, 1410 nt, Artificial Sequence; identical to SEQ ID NO: 114901
  derived and/or modified sequence opt2 from neuraminidase__InfluenzaA__AGT18728

SEQ ID NO: 115314 - RNA, 1410 nt, Artificial Sequence
  derived and/or modified sequence opt2 from neuraminidase__InfluenzaA__AGT18729
augaaccccaaccagaagaucaucaccaucggccaggucugcaugaccaucggcauggccaaccucauccuccagaucggcaacaucaucuccaucuggaucucccacuccauccagcucggcucccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115315 - RNA, 1410 nt, Artificial Sequence
  derived and/or modified sequence opt2 from neuraminidase__InfluenzaA__AGT18730
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115316 - RNA, 1410 nt, Artificial Sequence; identical to SEQ ID NO: 114901
  derived and/or modified sequence opt2 from neuraminidase__InfluenzaA__AGT18731

SEQ ID NO: 115317 - RNA, 1410 nt, Artificial Sequence
  derived and/or modified sequence opt2 from neuraminidase__InfluenzaA__AGT18732
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggacccgcggcuccuccaucuccuucugcggcgucaacuccgacaccgucggcugguccuggcccgacggcgccgagcuccccuucaccaucgacaaguga

SEQ ID NO: 115318 - RNA, 1410 nt, Artificial Sequence
  derived and/or modified sequence opt2 from neuraminidase__InfluenzaA__AGT18733
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgaguccaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccucccgcuccuucugcggcgucaacuccgacaccgucggcugguccuggcccgacggcgccgagcuccccuucaccaucgacaaguga

SEQ ID NO: 115319 - RNA, 1410 nt, Artificial Sequence
  derived and/or modified sequence opt2 from neuraminidase__InfluenzaA__AGT18762
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucacccucugcgagcccaucaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115320 - RNA, 1410 nt, Artificial Sequence
  derived and/or modified sequence opt2 from neuraminidase__InfluenzaA__AGT18764
augaaccccaaccagaugaucaucaccaucggcuccgucucccucaccuccuccaccaucugcuucuucaugcagaccgccuccuucaucaccaccgucacccuccacaucaagcagcacgaguuccacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgaccgcuccuccaacucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115321 - RNA, 1410 nt, Artificial Sequence
  derived and/or modified sequence opt2 from neuraminidase__InfluenzaA__AGT18765
augaaccccaaccagaagaucaucaccaucggcuccgucucccucaccaucuccaccaucugcuucuucaugcagaucgccauccucaucaccaccgucacccuccacuucaagcagcacgaguuccacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgaccgcuccuccaacucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115322 - RNA, 1410 nt, Artificial Sequence
  derived and/or modified sequence opt2 from neuraminidase__InfluenzaA__AGT18766
augaaccccaaccagaagaucaucaccaucggcuccgucucccucaccaucuccaccaucugccucuucaugcagaucgccauccucaucaccaccgucacccuccacuucaagcagcacgaguuccacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgaccgcuccuccaacucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaagcccaucuga

SEQ ID NO: 115323 - RNA, 1410 nt, Artificial Sequence
  derived and/or modified sequence opt2 from neuraminidase__InfluenzaA__AGT18767
augaaccccaaccagaagaucaucaccaucggcuccgucucccucaccaucuccaccaucugcuucuucaugcagaccgccucccucaucaccaccgucacccuccacuucaagcagcacgaguuccacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgaccgcuccuccaacucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115324 - RNA, 1410 nt, Artificial Sequence
  derived and/or modified sequence opt2 from neuraminidase__InfluenzaA__AGT18768
augaaccccaaccagaagaucaucaccaucggcuccgucucccucaccaucuccaccaucugcuucuucaugcagaccgccuccuucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgaccgcuccuccaacucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115325 - RNA, 1410 nt, Artificial Sequence; identical to SEQ ID NO: 113658
  derived and/or modified sequence opt2 from neuraminidase__InfluenzaA__AGT18769

SEQ ID NO: 115326 - RNA, 1410 nt, Artificial Sequence
  derived and/or modified sequence opt2 from neuraminidase__InfluenzaA__AGT18770
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaacaaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115327 - RNA, 1410 nt, Artificial Sequence
  derived and/or modified sequence opt2 from neuraminidase__InfluenzaA__AGT18771
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115328 - RNA, 1410 nt, Artificial Sequence; identical to SEQ ID NO: 113658
  derived and/or modified sequence opt2 from neuraminidase__InfluenzaA__AGT18772

SEQ ID NO: 115329 - RNA, 1410 nt, Artificial Sequence
  derived and/or modified sequence opt2 from neuraminidase__InfluenzaA__AGT37104
augaaccccaaccagaagaucaucaccaucggcuccgucucccucaccaucgccaccaucugccuccucaugcagaucgccauccucgucaccaccgucacccuccacuucaagcaguacgagugcuccuccccccccaacaaccaggucaugcccugcgagcccaccaucaucgagcgcaacaucaccaagaucgucuaccucaccaacaccaccaucgagcgcgaggccugccccgagcucgccgaguaccgccacugguccaagccccagugcaagauccgcggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggccacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagaucauguucgucgaggagggcaagaucguccacaucuccccccucgccggcuccgcccagcacgucgaggagugcuccugcuaccccaaguaccccggcguccgcugcgucugccgcgacaacuggaagggcuccaaccgccccaucgucgacaucaacaugaaggacuacuccaucgucuccuccuacgucugcuccggccucgucggcgacaccccccgccgcaacgacuccuccuccaccuccuacugccucaaccccaacaacgaggagggcggccacggcgucaagggcugggccuucgacgacggcgacgacgucuggaugggccgcaccaucuccgagaagcuccgccucggcuacgagaccuucaaggucaucggcggcugguccaagcccaacuccaagcuccagaucaaccgccaggucgucgucgacaucuccaaccgcuccggcuacuccggcaucuucuccgucgagggcaaguccugcaucaaccgcugcuucuacgucgagcucauccgcggccgcaagcaggagaacgaggucugguggaccuccaacuccaucgucgucuucugcggcaccuccggcaccuacggcaccggcuccuggcccgacggcgccgacaucaaccucaugcccaucuga

SEQ ID NO: 115330 - RNA, 1410 nt, Artificial Sequence
  derived and/or modified sequence opt2 from neuraminidase__InfluenzaA__AGU69973
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacguccgcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggcggcaagcaggagaccgagguccucuggaccuccaacuccaucgucgucuucugcggcaccuccggcaccuacggcaccggcuccuggcccgacggcgccgaccucaaccucaugcccaucuga

SEQ ID NO: 115331 - RNA, 1410 nt, Artificial Sequence
  derived and/or modified sequence opt2 from neuraminidase__InfluenzaA__AGU92648
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaucugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115332 - RNA, 1410 nt, Artificial Sequence
  derived and/or modified sequence opt2 from neuraminidase__InfluenzaA__AGU92670
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaucugcgucugccgcgacaacuggcacggcuccaaccgccccugggucuccuucaaccagaaccucgaguaccagaucggcuacaucugcuccggcaucuucggcgacaacccccgccccgacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115333 - RNA, 1410 nt, Artificial Sequence
  derived and/or modified sequence opt2 from neuraminidase__InfluenzaA__AGU92681
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaccuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaucugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115334 - RNA, 1410 nt, Artificial Sequence
  derived and/or modified sequence opt2 from neuraminidase__InfluenzaA__AGU92692
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcgucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucauccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115335 - RNA, 1410 nt, Artificial Sequence; identical to SEQ ID NO: 115334
  derived and/or modified sequence opt2 from neuraminidase__InfluenzaA__AGU92703

SEQ ID NO: 115336 - RNA, 1410 nt, Artificial Sequence; identical to SEQ ID NO: 115334
  derived and/or modified sequence opt2 from neuraminidase__InfluenzaA__AGU92714

SEQ ID NO: 115337 - RNA, 1410 nt, Artificial Sequence; identical to SEQ ID NO: 115334
  derived and/or modified sequence opt2 from neuraminidase__InfluenzaA__AGU92725

SEQ ID NO: 115338 - RNA, 1410 nt, Artificial Sequence; identical to SEQ ID NO: 115334
  derived and/or modified sequence opt2 from neuraminidase__InfluenzaA__AGU92736

SEQ ID NO: 115339 - RNA, 1410 nt, Artificial Sequence; identical to SEQ ID NO: 115334
  derived and/or modified sequence opt2 from neuraminidase__InfluenzaA__AGU92747

SEQ ID NO: 115340 - RNA, 1410 nt, Artificial Sequence; identical to SEQ ID NO: 115334
  derived and/or modified sequence opt2 from neuraminidase__InfluenzaA__AGU92758

SEQ ID NO: 115341 - RNA, 1410 nt, Artificial Sequence; identical to SEQ ID NO: 115331
  derived and/or modified sequence opt2 from neuraminidase__InfluenzaA__AGU92769

SEQ ID NO: 115342 - RNA, 1410 nt, Artificial Sequence; identical to SEQ ID NO: 115331
  derived and/or modified sequence opt2 from neuraminidase__InfluenzaA__AGU92780

SEQ ID NO: 115343 - RNA, 1410 nt, Artificial Sequence
  derived and/or modified sequence opt2 from neuraminidase__InfluenzaA__AGU92791
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaucuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaucugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115344 - RNA, 1410 nt, Artificial Sequence; identical to SEQ ID NO: 115331
  derived and/or modified sequence opt2 from neuraminidase__InfluenzaA__AGU92802

SEQ ID NO: 115345 - RNA, 1410 nt, Artificial Sequence; identical to SEQ ID NO: 115331
  derived and/or modified sequence opt2 from neuraminidase__InfluenzaA__AGU92813

SEQ ID NO: 115346 - RNA, 1410 nt, Artificial Sequence; identical to SEQ ID NO: 115331
  derived and/or modified sequence opt2 from neuraminidase__InfluenzaA__AGU92824

SEQ ID NO: 115347 - RNA, 1410 nt, Artificial Sequence
  derived and/or modified sequence opt2 from neuraminidase__InfluenzaA__AGU92846
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcgucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucgccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucauccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115348 - RNA, 1410 nt, Artificial Sequence
  derived and/or modified sequence opt2 from neuraminidase__InfluenzaA__AGU92868
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaaguucgccggcaacuccucccucugccccgucuccggcugggccaucuacuccaaggacaacuccguccgcgucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucauccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115349 - RNA, 1410 nt, Artificial Sequence
  derived and/or modified sequence opt2 from neuraminidase__InfluenzaA__AGU92890
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcgucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucauccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115350 - RNA, 1410 nt, Artificial Sequence; identical to SEQ ID NO: 115331
  derived and/or modified sequence opt2 from neuraminidase__InfluenzaA__AGU92901

SEQ ID NO: 115351 - RNA, 1410 nt, Artificial Sequence; identical to SEQ ID NO: 115331
  derived and/or modified sequence opt2 from neuraminidase__InfluenzaA__AGU92912

SEQ ID NO: 115352 - RNA, 1410 nt, Artificial Sequence; identical to SEQ ID NO: 115331
  derived and/or modified sequence opt2 from neuraminidase__InfluenzaA__AGU92923

SEQ ID NO: 115353 - RNA, 1410 nt, Artificial Sequence; identical to SEQ ID NO: 115334
  derived and/or modified sequence opt2 from neuraminidase__InfluenzaA__AGU92934

SEQ ID NO: 115354 - RNA, 1410 nt, Artificial Sequence; identical to SEQ ID NO: 115334
  derived and/or modified sequence opt2 from neuraminidase__InfluenzaA__AGU92945

SEQ ID NO: 115355 - RNA, 1410 nt, Artificial Sequence; identical to SEQ ID NO: 115334
  derived and/or modified sequence opt2 from neuraminidase__InfluenzaA__AGU92956

SEQ ID NO: 115356 - RNA, 1410 nt, Artificial Sequence; identical to SEQ ID NO: 115331
  derived and/or modified sequence opt2 from neuraminidase__InfluenzaA__AGU92967

SEQ ID NO: 115357 - RNA, 1410 nt, Artificial Sequence; identical to SEQ ID NO: 115331
  derived and/or modified sequence opt2 from neuraminidase__InfluenzaA__AGU92978

SEQ ID NO: 115358 - RNA, 1410 nt, Artificial Sequence
  derived and/or modified sequence opt2 from neuraminidase__InfluenzaA__AGU92989
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcgucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115359 - RNA, 1410 nt, Artificial Sequence; identical to SEQ ID NO: 115348
  derived and/or modified sequence opt2 from neuraminidase__InfluenzaA__AGU93000

SEQ ID NO: 115360 - RNA, 1410 nt, Artificial Sequence; identical to SEQ ID NO: 115349
  derived and/or modified sequence opt2 from neuraminidase__InfluenzaA__AGU93011

SEQ ID NO: 115361 - RNA, 1365 nt, Artificial Sequence; identical to SEQ ID NO: 111902
  derived and/or modified sequence opt2 from neuraminidase__InfluenzaA__AGU93022

SEQ ID NO: 115362 - RNA, 1410 nt, Artificial Sequence
  derived and/or modified sequence opt2 from neuraminidase__InfluenzaA__AGU93034
augaaccccacccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115363 - RNA, 1410 nt, Artificial Sequence; identical to SEQ ID NO: 114670
  derived and/or modified sequence opt2 from neuraminidase__InfluenzaA__AGU93045

SEQ ID NO: 115364 - RNA, 1410 nt, Artificial Sequence; identical to SEQ ID NO: 115331
  derived and/or modified sequence opt2 from neuraminidase__InfluenzaA__AGU93056

SEQ ID NO: 115365 - RNA, 1410 nt, Artificial Sequence; identical to SEQ ID NO: 113658
  derived and/or modified sequence opt2 from neuraminidase__InfluenzaA__AGV98980

SEQ ID NO: 115366 - RNA, 1410 nt, Artificial Sequence; identical to SEQ ID NO: 113658
  derived and/or modified sequence opt2 from neuraminidase__InfluenzaA__AGV98993

SEQ ID NO: 115367 - RNA, 1410 nt, Artificial Sequence; identical to SEQ ID NO: 113658
  derived and/or modified sequence opt2 from neuraminidase__InfluenzaA__AGV99005

SEQ ID NO: 115368 - RNA, 1410 nt, Artificial Sequence; identical to SEQ ID NO: 113658
  derived and/or modified sequence opt2 from neuraminidase__InfluenzaA__AGV99017

SEQ ID NO: 115369 - RNA, 1410 nt, Artificial Sequence; identical to SEQ ID NO: 113658
  derived and/or modified sequence opt2 from neuraminidase__InfluenzaA__AGV99040

SEQ ID NO: 115370 - RNA, 1410 nt, Artificial Sequence
  derived and/or modified sequence opt2 from neuraminidase__InfluenzaA__AGV99052
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccgucaucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115371 - RNA, 1410 nt, Artificial Sequence
  derived and/or modified sequence opt2 from neuraminidase__InfluenzaA__AGV99100
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcgucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115372 - RNA, 1410 nt, Artificial Sequence; identical to SEQ ID NO: 113658
  derived and/or modified sequence opt2 from neuraminidase__InfluenzaA__AGV99112

SEQ ID NO: 115373 - RNA, 1410 nt, Artificial Sequence; identical to SEQ ID NO: 113658
  derived and/or modified sequence opt2 from neuraminidase__InfluenzaA__AGV99124

SEQ ID NO: 115374 - RNA, 1410 nt, Artificial Sequence; identical to SEQ ID NO: 113658
  derived and/or modified sequence opt2 from neuraminidase__InfluenzaA__AGV99136

SEQ ID NO: 115375 - RNA, 1410 nt, Artificial Sequence; identical to SEQ ID NO: 113658
  derived and/or modified sequence opt2 from neuraminidase__InfluenzaA__AGV99148

SEQ ID NO: 115376 - RNA, 1410 nt, Artificial Sequence; identical to SEQ ID NO: 113658
  derived and/or modified sequence opt2 from neuraminidase__InfluenzaA__AGV99160

SEQ ID NO: 115377 - RNA, 1410 nt, Artificial Sequence; identical to SEQ ID NO: 113658
  derived and/or modified sequence opt2 from neuraminidase__InfluenzaA__AGV99172

SEQ ID NO: 115378 - RNA, 1410 nt, Artificial Sequence; identical to SEQ ID NO: 113658
  derived and/or modified sequence opt2 from neuraminidase__InfluenzaA__AGV99196

SEQ ID NO: 115379 - RNA, 1410 nt, Artificial Sequence; identical to SEQ ID NO: 113658
  derived and/or modified sequence opt2 from neuraminidase__InfluenzaA__AGV99208

SEQ ID NO: 115380 - RNA, 1410 nt, Artificial Sequence; identical to SEQ ID NO: 113658
  derived and/or modified sequence opt2 from neuraminidase__InfluenzaA__AGV99959

SEQ ID NO: 115381 - RNA, 1410 nt, Artificial Sequence; identical to SEQ ID NO: 114869
  derived and/or modified sequence opt2 from neuraminidase__InfluenzaA__AGW00005

SEQ ID NO: 115382 - RNA, 1410 nt, Artificial Sequence; identical to SEQ ID NO: 113658
  derived and/or modified sequence opt2 from neuraminidase__InfluenzaA__AGW00068

SEQ ID NO: 115383 - RNA, 1410 nt, Artificial Sequence
  derived and/or modified sequence opt2 from neuraminidase__InfluenzaA__AGW00080
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115384 - RNA, 1410 nt, Artificial Sequence
  derived and/or modified sequence opt2 from neuraminidase__InfluenzaA__AGW00104
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115385 - RNA, 1410 nt, Artificial Sequence; identical to SEQ ID NO: 115383
  derived and/or modified sequence opt2 from neuraminidase__InfluenzaA__AGW00116

SEQ ID NO: 115386 - RNA, 1410 nt, Artificial Sequence; identical to SEQ ID NO: 115383
  derived and/or modified sequence opt2 from neuraminidase__InfluenzaA__AGW00128

SEQ ID NO: 115387 - RNA, 1410 nt, Artificial Sequence; identical to SEQ ID NO: 113658
  derived and/or modified sequence opt2 from neuraminidase__InfluenzaA__AGW00140

SEQ ID NO: 115388 - RNA, 1410 nt, Artificial Sequence; identical to SEQ ID NO: 113658
  derived and/or modified sequence opt2 from neuraminidase__InfluenzaA__AGW00152

SEQ ID NO: 115389 - RNA, 1410 nt, Artificial Sequence; identical to SEQ ID NO: 115383
  derived and/or modified sequence opt2 from neuraminidase__InfluenzaA__AGW00164

SEQ ID NO: 115390 - RNA, 1410 nt, Artificial Sequence; identical to SEQ ID NO: 113658
  derived and/or modified sequence opt2 from neuraminidase__InfluenzaA__AGW00176

SEQ ID NO: 115391 - RNA, 1410 nt, Artificial Sequence; identical to SEQ ID NO: 113658
  derived and/or modified sequence opt2 from neuraminidase__InfluenzaA__AGW00188

SEQ ID NO: 115392 - RNA, 1410 nt, Artificial Sequence; identical to SEQ ID NO: 113658
  derived and/or modified sequence opt2 from neuraminidase__InfluenzaA__AGW00712

SEQ ID NO: 115393 - RNA, 1410 nt, Artificial Sequence; identical to SEQ ID NO: 113658
  derived and/or modified sequence opt2 from neuraminidase__InfluenzaA__AGW00724

SEQ ID NO: 115394 - RNA, 1410 nt, Artificial Sequence
  derived and/or modified sequence opt2 from neuraminidase__InfluenzaA__AGW00736
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccgaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115395 - RNA, 1410 nt, Artificial Sequence
  derived and/or modified sequence opt2 from neuraminidase__InfluenzaA__AGW00748
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115396 - RNA, 1410 nt, Artificial Sequence
  derived and/or modified sequence opt2 from neuraminidase__InfluenzaA__AGW00760
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccaggucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115397 - RNA, 1410 nt, Artificial Sequence; identical to SEQ ID NO: 113658
  derived and/or modified sequence opt2 from neuraminidase__InfluenzaA__AGW00784

SEQ ID NO: 115398 - RNA, 1410 nt, Artificial Sequence; identical to SEQ ID NO: 113658
  derived and/or modified sequence opt2 from neuraminidase__InfluenzaA__AGW00796

SEQ ID NO: 115399 - RNA, 1410 nt, Artificial Sequence; identical to SEQ ID NO: 115383
  derived and/or modified sequence opt2 from neuraminidase__InfluenzaA__AGW00808

SEQ ID NO: 115400 - RNA, 1410 nt, Artificial Sequence; identical to SEQ ID NO: 114887
  derived and/or modified sequence opt2 from neuraminidase__InfluenzaA__AGW00820

SEQ ID NO: 115401 - RNA, 1410 nt, Artificial Sequence; identical to SEQ ID NO: 113658
  derived and/or modified sequence opt2 from neuraminidase__InfluenzaA__AGW00832

SEQ ID NO: 115402 - RNA, 1410 nt, Artificial Sequence
  derived and/or modified sequence opt2 from neuraminidase__InfluenzaA__AGW00844
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115403 - RNA, 1410 nt, Artificial Sequence; identical to SEQ ID NO: 115395
  derived and/or modified sequence opt2 from neuraminidase__InfluenzaA__AGW00868

SEQ ID NO: 115404 - RNA, 1410 nt, Artificial Sequence
  derived and/or modified sequence opt2 from neuraminidase__InfluenzaA__AGW00880
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacgucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccgacguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115405 - RNA, 1410 nt, Artificial Sequence
  derived and/or modified sequence opt2 from neuraminidase__InfluenzaA__AGW00892
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaugaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115406 - RNA, 1410 nt, Artificial Sequence
  derived and/or modified sequence opt2 from neuraminidase__InfluenzaA__AGW00904
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115407 - RNA, 1410 nt, Artificial Sequence
  derived and/or modified sequence opt2 from neuraminidase__InfluenzaA__AGW00916
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccgucugcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115408 - RNA, 1410 nt, Artificial Sequence; identical to SEQ ID NO: 115383
  derived and/or modified sequence opt2 from neuraminidase__InfluenzaA__AGW00934

SEQ ID NO: 115409 - RNA, 1410 nt, Artificial Sequence
  derived and/or modified sequence opt2 from neuraminidase__InfluenzaA__AGW01247
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaaggacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115410 - RNA, 1410 nt, Artificial Sequence; identical to SEQ ID NO: 113658
  derived and/or modified sequence opt2 from neuraminidase__InfluenzaA__AGW01259

SEQ ID NO: 115411 - RNA, 1410 nt, Artificial Sequence; identical to SEQ ID NO: 115395
  derived and/or modified sequence opt2 from neuraminidase__InfluenzaA__AGW01298

SEQ ID NO: 115412 - RNA, 1410 nt, Artificial Sequence; identical to SEQ ID NO: 114887
  derived and/or modified sequence opt2 from neuraminidase__InfluenzaA__AGW01322

SEQ ID NO: 115413 - RNA, 1410 nt, Artificial Sequence
  derived and/or modified sequence opt2 from neuraminidase__InfluenzaA__AGW01334
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggaggccgagguccucuggaccuccaacuccaucgucgucuucugcggcaccuccggcaccuacggcaccggcuccuggcccgacggcgccgaccucaaccucaugcccaucuga

SEQ ID NO: 115414 - RNA, 1410 nt, Artificial Sequence; identical to SEQ ID NO: 113658
  derived and/or modified sequence opt2 from neuraminidase__InfluenzaA__AGW01346

SEQ ID NO: 115415 - RNA, 1410 nt, Artificial Sequence
  derived and/or modified sequence opt2 from neuraminidase__InfluenzaA__AGW01358
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccaccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115416 - RNA, 1410 nt, Artificial Sequence; identical to SEQ ID NO: 113658
  derived and/or modified sequence opt2 from neuraminidase__InfluenzaA__AGW01370

SEQ ID NO: 115417 - RNA, 1410 nt, Artificial Sequence; identical to SEQ ID NO: 113658
  derived and/or modified sequence opt2 from neuraminidase__InfluenzaA__AGW01382

SEQ ID NO: 115418 - RNA, 1410 nt, Artificial Sequence
  derived and/or modified sequence opt2 from neuraminidase__InfluenzaA__AGW01394
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115419 - RNA, 1410 nt, Artificial Sequence
  derived and/or modified sequence opt2 from neuraminidase__InfluenzaA__AGW01406
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaucaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115420 - RNA, 1410 nt, Artificial Sequence
  derived and/or modified sequence opt2 from neuraminidase__InfluenzaA__AGW01418
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccggcguccucuggaccuccaacuccaucgucgucuucugcggcaccuccggcaccuacggcaccggcuccuggcccgacggcgccgaccucaaccucaugcccaucuga

SEQ ID NO: 115421 - RNA, 1410 nt, Artificial Sequence; identical to SEQ ID NO: 113658
  derived and/or modified sequence opt2 from neuraminidase__InfluenzaA__AGW01430

SEQ ID NO: 115422 - RNA, 1410 nt, Artificial Sequence; identical to SEQ ID NO: 113658
  derived and/or modified sequence opt2 from neuraminidase__InfluenzaA__AGW01442

SEQ ID NO: 115423 - RNA, 1410 nt, Artificial Sequence; identical to SEQ ID NO: 113658
  derived and/or modified sequence opt2 from neuraminidase__InfluenzaA__AGW01454

SEQ ID NO: 115424 - RNA, 1410 nt, Artificial Sequence; identical to SEQ ID NO: 115383
  derived and/or modified sequence opt2 from neuraminidase__InfluenzaA__AGW01466

SEQ ID NO: 115425 - RNA, 1410 nt, Artificial Sequence; identical to SEQ ID NO: 113658
  derived and/or modified sequence opt2 from neuraminidase__InfluenzaA__AGW01478

SEQ ID NO: 115426 - RNA, 1410 nt, Artificial Sequence
  derived and/or modified sequence opt2 from neuraminidase__InfluenzaA__AGW01490
augaaccccaaccagaagaucaucaccaucuccuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaacuccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115427 - RNA, 1410 nt, Artificial Sequence; identical to SEQ ID NO: 113658
  derived and/or modified sequence opt2 from neuraminidase__InfluenzaA__AGW01538

SEQ ID NO: 115428 - RNA, 1410 nt, Artificial Sequence; identical to SEQ ID NO: 115383
  derived and/or modified sequence opt2 from neuraminidase__InfluenzaA__AGW01562

SEQ ID NO: 115429 - RNA, 1410 nt, Artificial Sequence; identical to SEQ ID NO: 113658
  derived and/or modified sequence opt2 from neuraminidase__InfluenzaA__AGW01574

SEQ ID NO: 115430 - RNA, 1410 nt, Artificial Sequence; identical to SEQ ID NO: 113658
  derived and/or modified sequence opt2 from neuraminidase__InfluenzaA__AGW01586

SEQ ID NO: 115431 - RNA, 1410 nt, Artificial Sequence; identical to SEQ ID NO: 113658
  derived and/or modified sequence opt2 from neuraminidase__InfluenzaA__AGW01598

SEQ ID NO: 115432 - RNA, 1410 nt, Artificial Sequence; identical to SEQ ID NO: 115383
  derived and/or modified sequence opt2 from neuraminidase__InfluenzaA__AGW01610

SEQ ID NO: 115433 - RNA, 1410 nt, Artificial Sequence; identical to SEQ ID NO: 113658
  derived and/or modified sequence opt2 from neuraminidase__InfluenzaA__AGW01622

SEQ ID NO: 115434 - RNA, 1410 nt, Artificial Sequence; identical to SEQ ID NO: 113658
  derived and/or modified sequence opt2 from neuraminidase__InfluenzaA__AGW01634

SEQ ID NO: 115435 - RNA, 1410 nt, Artificial Sequence
  derived and/or modified sequence opt2 from neuraminidase__InfluenzaA__AGW01646
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucgacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115436 - RNA, 1410 nt, Artificial Sequence; identical to SEQ ID NO: 113658
  derived and/or modified sequence opt2 from neuraminidase__InfluenzaA__AGW01670

SEQ ID NO: 115437 - RNA, 1410 nt, Artificial Sequence; identical to SEQ ID NO: 113658
  derived and/or modified sequence opt2 from neuraminidase__InfluenzaA__AGW01682

SEQ ID NO: 115438 - RNA, 1410 nt, Artificial Sequence; identical to SEQ ID NO: 115395
  derived and/or modified sequence opt2 from neuraminidase__InfluenzaA__AGW01704

SEQ ID NO: 115439 - RNA, 1410 nt, Artificial Sequence
  derived and/or modified sequence opt2 from neuraminidase__InfluenzaA__AGW01716
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggccgcuccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115440 - RNA, 1410 nt, Artificial Sequence
  derived and/or modified sequence opt2 from neuraminidase__InfluenzaA__AGW01728
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccgucgucgucuucugcggcaccuccggcaccuacggcaccggcuccuggcccgacggcgccgaccucaaccucaugcccaucuga

SEQ ID NO: 115441 - RNA, 1410 nt, Artificial Sequence; identical to SEQ ID NO: 113658
  derived and/or modified sequence opt2 from neuraminidase__InfluenzaA__AGW01740

SEQ ID NO: 115442 - RNA, 1410 nt, Artificial Sequence
  derived and/or modified sequence opt2 from neuraminidase__InfluenzaA__AGW01752
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucggcggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115443 - RNA, 1410 nt, Artificial Sequence; identical to SEQ ID NO: 113658
  derived and/or modified sequence opt2 from neuraminidase__InfluenzaA__AGW01764

SEQ ID NO: 115444 - RNA, 1410 nt, Artificial Sequence; identical to SEQ ID NO: 115395
  derived and/or modified sequence opt2 from neuraminidase__InfluenzaA__AGW01776

SEQ ID NO: 115445 - RNA, 1410 nt, Artificial Sequence; identical to SEQ ID NO: 115383
  derived and/or modified sequence opt2 from neuraminidase__InfluenzaA__AGW01788

SEQ ID NO: 115446 - RNA, 1410 nt, Artificial Sequence; identical to SEQ ID NO: 115395
  derived and/or modified sequence opt2 from neuraminidase__InfluenzaA__AGW01800

SEQ ID NO: 115447 - RNA, 1410 nt, Artificial Sequence; identical to SEQ ID NO: 115383
  derived and/or modified sequence opt2 from neuraminidase__InfluenzaA__AGW01812

SEQ ID NO: 115448 - RNA, 1410 nt, Artificial Sequence; identical to SEQ ID NO: 115383
  derived and/or modified sequence opt2 from neuraminidase__InfluenzaA__AGW01824

SEQ ID NO: 115449 - RNA, 1410 nt, Artificial Sequence; identical to SEQ ID NO: 115406
  derived and/or modified sequence opt2 from neuraminidase__InfluenzaA__AGW01848

SEQ ID NO: 115450 - RNA, 1410 nt, Artificial Sequence
  derived and/or modified sequence opt2 from neuraminidase__InfluenzaA__AGW01860
augaaccccaaccagaagaucaucaccaucggcuccgucucccucaccaucuccaccaucugcuucuucaugcagaucgccauccucaucaccaccgucacccuccacuucaagcaguacgaguucaacucccuccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugcuucgaccccaacaacgaggagggcggccacggcgucaagggcugggccuucgacgacggcaacgacgucuggaugggccgcaccaucaacgagaccucccgccucggcuacgagaccuucaaggucaucggcggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucaucgucuucugcggcaccuccggcaccuacggcaccggcuccuggcccgacggcgccgaccucaaccucaugcccaucuga

SEQ ID NO: 115451 - RNA, 1410 nt, Artificial Sequence
  derived and/or modified sequence opt2 from neuraminidase__InfluenzaA__AGW01884
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccaagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115452 - RNA, 1410 nt, Artificial Sequence; identical to SEQ ID NO: 113658
  derived and/or modified sequence opt2 from neuraminidase__InfluenzaA__AGW01896

SEQ ID NO: 115453 - RNA, 1410 nt, Artificial Sequence; identical to SEQ ID NO: 113658
  derived and/or modified sequence opt2 from neuraminidase__InfluenzaA__AGW01908

SEQ ID NO: 115454 - RNA, 1410 nt, Artificial Sequence; identical to SEQ ID NO: 113658
  derived and/or modified sequence opt2 from neuraminidase__InfluenzaA__AGW01920

SEQ ID NO: 115455 - RNA, 1410 nt, Artificial Sequence; identical to SEQ ID NO: 113658
  derived and/or modified sequence opt2 from neuraminidase__InfluenzaA__AGW01932

SEQ ID NO: 115456 - RNA, 1410 nt, Artificial Sequence
  derived and/or modified sequence opt2 from neuraminidase__InfluenzaA__AGW01944
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgcccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115457 - RNA, 1410 nt, Artificial Sequence; identical to SEQ ID NO: 113658
  derived and/or modified sequence opt2 from neuraminidase__InfluenzaA__AGW01956

SEQ ID NO: 115458 - RNA, 1410 nt, Artificial Sequence
  derived and/or modified sequence opt2 from neuraminidase__InfluenzaA__AGW01968
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccauccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacgagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115459 - RNA, 1410 nt, Artificial Sequence; identical to SEQ ID NO: 115383
  derived and/or modified sequence opt2 from neuraminidase__InfluenzaA__AGW01980

SEQ ID NO: 115460 - RNA, 1410 nt, Artificial Sequence; identical to SEQ ID NO: 113658
  derived and/or modified sequence opt2 from neuraminidase__InfluenzaA__AGW01992

SEQ ID NO: 115461 - RNA, 1410 nt, Artificial Sequence; identical to SEQ ID NO: 113658
  derived and/or modified sequence opt2 from neuraminidase__InfluenzaA__AGW02004

SEQ ID NO: 115462 - RNA, 1410 nt, Artificial Sequence; identical to SEQ ID NO: 113658
  derived and/or modified sequence opt2 from neuraminidase__InfluenzaA__AGW02016

SEQ ID NO: 115463 - RNA, 1410 nt, Artificial Sequence; identical to SEQ ID NO: 113658
  derived and/or modified sequence opt2 from neuraminidase__InfluenzaA__AGW02040

SEQ ID NO: 115464 - RNA, 1410 nt, Artificial Sequence
  derived and/or modified sequence opt2 from neuraminidase__InfluenzaA__AGW02064
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115465 - RNA, 1410 nt, Artificial Sequence; identical to SEQ ID NO: 113658
  derived and/or modified sequence opt2 from neuraminidase__InfluenzaA__AGW02076

SEQ ID NO: 115466 - RNA, 1410 nt, Artificial Sequence; identical to SEQ ID NO: 113658
  derived and/or modified sequence opt2 from neuraminidase__InfluenzaA__AGW02088

SEQ ID NO: 115467 - RNA, 1410 nt, Artificial Sequence
  derived and/or modified sequence opt2 from neuraminidase__InfluenzaA__AGW02100
augaaccccaaccagaagaucaucaccaucggcuccgucucccucaccaucuccaccaucugcuucuucaugcagaucgccauccucaucaccaccgucacccuccacuucaagcaguacgaguccaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115468 - RNA, 1410 nt, Artificial Sequence; identical to SEQ ID NO: 115395
  derived and/or modified sequence opt2 from neuraminidase__InfluenzaA__AGW02112

SEQ ID NO: 115469 - RNA, 1410 nt, Artificial Sequence
  derived and/or modified sequence opt2 from neuraminidase__InfluenzaA__AGW02124
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgucuccgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115470 - RNA, 1410 nt, Artificial Sequence; identical to SEQ ID NO: 115383
  derived and/or modified sequence opt2 from neuraminidase__InfluenzaA__AGW02136

SEQ ID NO: 115471 - RNA, 1410 nt, Artificial Sequence; identical to SEQ ID NO: 115395
  derived and/or modified sequence opt2 from neuraminidase__InfluenzaA__AGW02148

SEQ ID NO: 115472 - RNA, 1410 nt, Artificial Sequence
  derived and/or modified sequence opt2 from neuraminidase__InfluenzaA__AGW02160
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115473 - RNA, 1410 nt, Artificial Sequence; identical to SEQ ID NO: 113658
  derived and/or modified sequence opt2 from neuraminidase__InfluenzaA__AGW02172

SEQ ID NO: 115474 - RNA, 1410 nt, Artificial Sequence; identical to SEQ ID NO: 113658
  derived and/or modified sequence opt2 from neuraminidase__InfluenzaA__AGW02184

SEQ ID NO: 115475 - RNA, 1410 nt, Artificial Sequence
  derived and/or modified sequence opt2 from neuraminidase__InfluenzaA__AGW02196
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaucaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccuacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115476 - RNA, 1410 nt, Artificial Sequence; identical to SEQ ID NO: 114887
  derived and/or modified sequence opt2 from neuraminidase__InfluenzaA__AGW04174

SEQ ID NO: 115477 - RNA, 1410 nt, Artificial Sequence
  derived and/or modified sequence opt2 from neuraminidase__InfluenzaA__AGW25784
augaaccccaaccagaagaucaucaccaucggcuccgucucccucaucaucgccaccaucugcuuccucaugcagaucgccauccucgucaccaccgucacccuccacuucaagcaguacggcuacaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccuacaagugcuaccaguucgcccucggccagggcaccacccucaacaacaagcacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacaucugcgucaccggccacgacgagaacgccaccgccuccuucaucuacgacggcaagcucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcauccgcugcgucugccgcgacaacuggaagggcuccaaccgccccaucgucgacaucaacgucaaggacuacuccaucaccuccuccuacgucugcuccggccucgucggcgacaccccccgcaagaccgacaacuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucaagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcgcgaggccgaggucugguggaccuccaacuccaucgucgucuucugcggcaccuccggcaccuacggcaccggcuccuggcccgacggcgccgacaucaaccucaugcccaucuga

SEQ ID NO: 115478 - RNA, 1350 nt, Artificial Sequence
  derived and/or modified sequence opt2 from neuraminidase__InfluenzaA__AGW27062
augaaccccaaccagaagaucgucaccaucggcuccaucugcauggucaucggcaccaucucccucaugcuccagaucggcaacaucaucuccaucugggucucccacuccauccagaccggcaaccagcaccagaccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccaucggcgaggcccccucccccuacaacucccgcuucgaguccgucgccugguccgccuccgccugccacgacggcaccuccuggcucgucaucggcaucuccggccccgacaacggcgccgucgccguccucaaguacaacggcaucaucaccgacaccauccgcuccuggcgcaacaacauccuccgcacccaggaguccgagugcgccugcgucaacggcuccugcuucaccgucaugaccgacggccccuccaacggccaggccuccuacaagaucuucaagaucgagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccacccacucccgcuccggcuucgagaugaucugggaccccaacggcuggaccggcaccgacuccgaguucuccaugaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 115479 - RNA, 1410 nt, Artificial Sequence
  derived and/or modified sequence opt2 from neuraminidase__InfluenzaA__AGY14472
augaaccccaaccagaagaucaucaccaucggcuccgucucccucacccucgccaccaucugcuuccucaugcagaucgccauccucgucaccaccgucacccuccacuucaagcaguacgagugcaacuccacccccaacaaccaggucaugcucugcgagcccaccgucaucgagcgcaacaucaccaagaucgucuaccucaccaacaccaccgucgagaaggagaucugccccaagcccgccgaguaccgcaacugguccaagccccagugcaagaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaaccgccacuccaacgacaccguccacgaccgcacccccuaccgcacccuccucaugaacgagcucggcauccccuuccaccucggcaccaagcaggucugcaucgccugguccuccuccuccugccacgacggcaaggccuggcuccacgucugcgucaccggccacgacaagaacgccaccgccuccuucaucuacgacggcaagcucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcauccgcugcgucugccgcgacaacuggaagggcuccaaccgccccaucgucgacaucaacgucaaggacuacuccaucaccuccuccuacgucugcuccggccucgucggcgacaccccccgcaagaccgacaacuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucaagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcgcgaggccgaggucugguggaccuccaacuccaucgucgucuucugcggcaccuccggcaccuacggcaccggcuccuggcccgacggcgccgacaucaaccucaugcccaucuga

SEQ ID NO: 115480 - RNA, 1398 nt, Artificial Sequence
  derived and/or modified sequence opt2 from neuraminidase__InfluenzaA__AHA11501
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccaucgucuucaccgacggcuccgccaccggccccgccgacacccgcaucuacuacuucaaggagggcaagauccucgagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaccccccgccccaacgaccccaacaucggcaagugcaacgaccccuaccccggcaacgacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgcccgcaucgaguacuuccucuga

SEQ ID NO: 115481 - RNA, 1410 nt, Artificial Sequence
  derived and/or modified sequence opt2 from neuraminidase__InfluenzaA__AHC57462
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugcugggaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccaggucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115482 - RNA, 1410 nt, Artificial Sequence; identical to SEQ ID NO: 111030
  derived and/or modified sequence opt2 from neuraminidase__InfluenzaA__AHC57490

SEQ ID NO: 115483 - RNA, 1410 nt, Artificial Sequence
  derived and/or modified sequence opt2 from neuraminidase__InfluenzaA__AHC57514
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115484 - RNA, 1410 nt, Artificial Sequence; identical to SEQ ID NO: 115483
  derived and/or modified sequence opt2 from neuraminidase__InfluenzaA__AHC57526

SEQ ID NO: 115485 - RNA, 1410 nt, Artificial Sequence; identical to SEQ ID NO: 115483
  derived and/or modified sequence opt2 from neuraminidase__InfluenzaA__AHC57806

SEQ ID NO: 115486 - RNA, 1410 nt, Artificial Sequence; identical to SEQ ID NO: 115483
  derived and/or modified sequence opt2 from neuraminidase__InfluenzaA__AHC57818

SEQ ID NO: 115487 - RNA, 1410 nt, Artificial Sequence
  derived and/or modified sequence opt2 from neuraminidase__InfluenzaA__AHC57830
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115488 - RNA, 1410 nt, Artificial Sequence; identical to SEQ ID NO: 115487
  derived and/or modified sequence opt2 from neuraminidase__InfluenzaA__AHC57971

SEQ ID NO: 115489 - RNA, 1410 nt, Artificial Sequence; identical to SEQ ID NO: 115483
  derived and/or modified sequence opt2 from neuraminidase__InfluenzaA__AHC57984

SEQ ID NO: 115490 - RNA, 1410 nt, Artificial Sequence
  derived and/or modified sequence opt2 from neuraminidase__InfluenzaA__AHC57996
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcaccccccaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115491 - RNA, 1410 nt, Artificial Sequence; identical to SEQ ID NO: 114434
  derived and/or modified sequence opt2 from neuraminidase__InfluenzaA__AHC58008

SEQ ID NO: 115492 - RNA, 1410 nt, Artificial Sequence; identical to SEQ ID NO: 111030
  derived and/or modified sequence opt2 from neuraminidase__InfluenzaA__AHC58020

SEQ ID NO: 115493 - RNA, 1410 nt, Artificial Sequence
  derived and/or modified sequence opt2 from neuraminidase__InfluenzaA__AHC58032
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115494 - RNA, 1410 nt, Artificial Sequence; identical to SEQ ID NO: 114434
  derived and/or modified sequence opt2 from neuraminidase__InfluenzaA__AHC58053

SEQ ID NO: 115495 - RNA, 1410 nt, Artificial Sequence
  derived and/or modified sequence opt2 from neuraminidase__InfluenzaA__AHC58077
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcuccgcgagcccaccaucaucgagcgcaacaucaccgagaucgucuaccucaccaacaccaccaccgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115496 - RNA, 1410 nt, Artificial Sequence; identical to SEQ ID NO: 115487
  derived and/or modified sequence opt2 from neuraminidase__InfluenzaA__AHC58089

SEQ ID NO: 115497 - RNA, 1410 nt, Artificial Sequence; identical to SEQ ID NO: 115483
  derived and/or modified sequence opt2 from neuraminidase__InfluenzaA__AHC58101

SEQ ID NO: 115498 - RNA, 1410 nt, Artificial Sequence
  derived and/or modified sequence opt2 from neuraminidase__InfluenzaA__AHC58113
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115499 - RNA, 1410 nt, Artificial Sequence; identical to SEQ ID NO: 115483
  derived and/or modified sequence opt2 from neuraminidase__InfluenzaA__AHC58129

SEQ ID NO: 115500 - RNA, 1410 nt, Artificial Sequence; identical to SEQ ID NO: 115483
  derived and/or modified sequence opt2 from neuraminidase__InfluenzaA__AHC58153

SEQ ID NO: 115501 - RNA, 1410 nt, Artificial Sequence; identical to SEQ ID NO: 115483
  derived and/or modified sequence opt2 from neuraminidase__InfluenzaA__AHC58165

SEQ ID NO: 115502 - RNA, 1410 nt, Artificial Sequence; identical to SEQ ID NO: 115487
  derived and/or modified sequence opt2 from neuraminidase__InfluenzaA__AHC58177

SEQ ID NO: 115503 - RNA, 1410 nt, Artificial Sequence
  derived and/or modified sequence opt2 from neuraminidase__InfluenzaA__AHC58189
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaugucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115504 - RNA, 1410 nt, Artificial Sequence; identical to SEQ ID NO: 115483
  derived and/or modified sequence opt2 from neuraminidase__InfluenzaA__AHC58201

SEQ ID NO: 115505 - RNA, 1410 nt, Artificial Sequence
  derived and/or modified sequence opt2 from neuraminidase__InfluenzaA__AHC58225
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucaaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115506 - RNA, 1410 nt, Artificial Sequence; identical to SEQ ID NO: 115487
  derived and/or modified sequence opt2 from neuraminidase__InfluenzaA__AHC58237

SEQ ID NO: 115507 - RNA, 1410 nt, Artificial Sequence; identical to SEQ ID NO: 115483
  derived and/or modified sequence opt2 from neuraminidase__InfluenzaA__AHC58249

SEQ ID NO: 115508 - RNA, 1410 nt, Artificial Sequence; identical to SEQ ID NO: 111030
  derived and/or modified sequence opt2 from neuraminidase__InfluenzaA__AHC58273

SEQ ID NO: 115509 - RNA, 1410 nt, Artificial Sequence; identical to SEQ ID NO: 115487
  derived and/or modified sequence opt2 from neuraminidase__InfluenzaA__AHC58363

SEQ ID NO: 115510 - RNA, 1410 nt, Artificial Sequence; identical to SEQ ID NO: 114434
  derived and/or modified sequence opt2 from neuraminidase__InfluenzaA__AHC58375

SEQ ID NO: 115511 - RNA, 1410 nt, Artificial Sequence; identical to SEQ ID NO: 115487
  derived and/or modified sequence opt2 from neuraminidase__InfluenzaA__AHC58387

SEQ ID NO: 115512 - RNA, 1410 nt, Artificial Sequence; identical to SEQ ID NO: 115487
  derived and/or modified sequence opt2 from neuraminidase__InfluenzaA__AHC58399

SEQ ID NO: 115513 - RNA, 1410 nt, Artificial Sequence; identical to SEQ ID NO: 115483
  derived and/or modified sequence opt2 from neuraminidase__InfluenzaA__AHC58411

SEQ ID NO: 115514 - RNA, 1410 nt, Artificial Sequence; identical to SEQ ID NO: 114434
  derived and/or modified sequence opt2 from neuraminidase__InfluenzaA__AHC58423

SEQ ID NO: 115515 - RNA, 1410 nt, Artificial Sequence; identical to SEQ ID NO: 115487
  derived and/or modified sequence opt2 from neuraminidase__InfluenzaA__AHC58459

SEQ ID NO: 115516 - RNA, 1410 nt, Artificial Sequence
  derived and/or modified sequence opt2 from neuraminidase__InfluenzaA__AHC58471
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccagcccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcgccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115517 - RNA, 1410 nt, Artificial Sequence; identical to SEQ ID NO: 115483
  derived and/or modified sequence opt2 from neuraminidase__InfluenzaA__AHC58482

SEQ ID NO: 115518 - RNA, 1410 nt, Artificial Sequence; identical to SEQ ID NO: 115487
  derived and/or modified sequence opt2 from neuraminidase__InfluenzaA__AHC58494

SEQ ID NO: 115519 - RNA, 1410 nt, Artificial Sequence
  derived and/or modified sequence opt2 from neuraminidase__InfluenzaA__AHC58518
augaaccccaaccagaagaucaucaccaucggcuccgucucccucaccaucuccaccaucugcuucuucaugcaggucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115520 - RNA, 1410 nt, Artificial Sequence; identical to SEQ ID NO: 115483
  derived and/or modified sequence opt2 from neuraminidase__InfluenzaA__AHC58530

SEQ ID NO: 115521 - RNA, 1410 nt, Artificial Sequence; identical to SEQ ID NO: 115483
  derived and/or modified sequence opt2 from neuraminidase__InfluenzaA__AHC58554

SEQ ID NO: 115522 - RNA, 1410 nt, Artificial Sequence; identical to SEQ ID NO: 115483
  derived and/or modified sequence opt2 from neuraminidase__InfluenzaA__AHC58566

SEQ ID NO: 115523 - RNA, 1410 nt, Artificial Sequence
  derived and/or modified sequence opt2 from neuraminidase__InfluenzaA__AHC58578
augaaccccaaccagaagaucaucaccaucggcuccgucucccucaccgucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115524 - RNA, 1410 nt, Artificial Sequence; identical to SEQ ID NO: 111030
  derived and/or modified sequence opt2 from neuraminidase__InfluenzaA__AHC58590

SEQ ID NO: 115525 - RNA, 1410 nt, Artificial Sequence; identical to SEQ ID NO: 115519
  derived and/or modified sequence opt2 from neuraminidase__InfluenzaA__AHC58602

SEQ ID NO: 115526 - RNA, 1410 nt, Artificial Sequence; identical to SEQ ID NO: 115483
  derived and/or modified sequence opt2 from neuraminidase__InfluenzaA__AHC58614

SEQ ID NO: 115527 - RNA, 1410 nt, Artificial Sequence; identical to SEQ ID NO: 115483
  derived and/or modified sequence opt2 from neuraminidase__InfluenzaA__AHC58626

SEQ ID NO: 115528 - RNA, 1410 nt, Artificial Sequence; identical to SEQ ID NO: 115483
  derived and/or modified sequence opt2 from neuraminidase__InfluenzaA__AHC58638

SEQ ID NO: 115529 - RNA, 1410 nt, Artificial Sequence; identical to SEQ ID NO: 115483
  derived and/or modified sequence opt2 from neuraminidase__InfluenzaA__AHC58650

SEQ ID NO: 115530 - RNA, 1410 nt, Artificial Sequence
  derived and/or modified sequence opt2 from neuraminidase__InfluenzaA__AHC58662
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115531 - RNA, 1410 nt, Artificial Sequence
  derived and/or modified sequence opt2 from neuraminidase__InfluenzaA__AHC58686
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115532 - RNA, 1410 nt, Artificial Sequence
  derived and/or modified sequence opt2 from neuraminidase__InfluenzaA__AHC58698
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115533 - RNA, 1410 nt, Artificial Sequence; identical to SEQ ID NO: 114434
  derived and/or modified sequence opt2 from neuraminidase__InfluenzaA__AHC58710

SEQ ID NO: 115534 - RNA, 1410 nt, Artificial Sequence; identical to SEQ ID NO: 114434
  derived and/or modified sequence opt2 from neuraminidase__InfluenzaA__AHC58722

SEQ ID NO: 115535 - RNA, 1410 nt, Artificial Sequence
  derived and/or modified sequence opt2 from neuraminidase__InfluenzaA__AHC58734
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcauccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115536 - RNA, 1410 nt, Artificial Sequence; identical to SEQ ID NO: 115483
  derived and/or modified sequence opt2 from neuraminidase__InfluenzaA__AHC58746

SEQ ID NO: 115537 - RNA, 1410 nt, Artificial Sequence; identical to SEQ ID NO: 115487
  derived and/or modified sequence opt2 from neuraminidase__InfluenzaA__AHC58758

SEQ ID NO: 115538 - RNA, 1410 nt, Artificial Sequence; identical to SEQ ID NO: 115483
  derived and/or modified sequence opt2 from neuraminidase__InfluenzaA__AHC58770

SEQ ID NO: 115539 - RNA, 1410 nt, Artificial Sequence; identical to SEQ ID NO: 111030
  derived and/or modified sequence opt2 from neuraminidase__InfluenzaA__AHC58782

SEQ ID NO: 115540 - RNA, 1410 nt, Artificial Sequence; identical to SEQ ID NO: 115483
  derived and/or modified sequence opt2 from neuraminidase__InfluenzaA__AHC58806

SEQ ID NO: 115541 - RNA, 1410 nt, Artificial Sequence
  derived and/or modified sequence opt2 from neuraminidase__InfluenzaA__AHC58818
augaaccccaaccagaagaucaucaccaucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115542 - RNA, 1410 nt, Artificial Sequence; identical to SEQ ID NO: 115532
  derived and/or modified sequence opt2 from neuraminidase__InfluenzaA__AHC58830

SEQ ID NO: 115543 - RNA, 1410 nt, Artificial Sequence; identical to SEQ ID NO: 115483
  derived and/or modified sequence opt2 from neuraminidase__InfluenzaA__AHC58842

SEQ ID NO: 115544 - RNA, 1410 nt, Artificial Sequence
  derived and/or modified sequence opt2 from neuraminidase__InfluenzaA__AHC58866
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccgcgucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccggcguccucuggaccuccaacuccaucgucgucuucugcggcaccuccggcaccuacggcaccggcuccuggcccgacggcgccgaccucaaccucaugcccaucuga

SEQ ID NO: 115545 - RNA, 1410 nt, Artificial Sequence; identical to SEQ ID NO: 115532
  derived and/or modified sequence opt2 from neuraminidase__InfluenzaA__AHC58878

SEQ ID NO: 115546 - RNA, 1410 nt, Artificial Sequence; identical to SEQ ID NO: 115483
  derived and/or modified sequence opt2 from neuraminidase__InfluenzaA__AHC58890

SEQ ID NO: 115547 - RNA, 1410 nt, Artificial Sequence; identical to SEQ ID NO: 115487
  derived and/or modified sequence opt2 from neuraminidase__InfluenzaA__AHC58902

SEQ ID NO: 115548 - RNA, 1410 nt, Artificial Sequence; identical to SEQ ID NO: 115483
  derived and/or modified sequence opt2 from neuraminidase__InfluenzaA__AHC58996

SEQ ID NO: 115549 - RNA, 1410 nt, Artificial Sequence; identical to SEQ ID NO: 115483
  derived and/or modified sequence opt2 from neuraminidase__InfluenzaA__AHC59008

SEQ ID NO: 115550 - RNA, 1410 nt, Artificial Sequence; identical to SEQ ID NO: 115487
  derived and/or modified sequence opt2 from neuraminidase__InfluenzaA__AHC59020

SEQ ID NO: 115551 - RNA, 1410 nt, Artificial Sequence
  derived and/or modified sequence opt2 from neuraminidase__InfluenzaA__AHC59032
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccuccguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115552 - RNA, 1410 nt, Artificial Sequence; identical to SEQ ID NO: 115519
  derived and/or modified sequence opt2 from neuraminidase__InfluenzaA__AHC59044

SEQ ID NO: 115553 - RNA, 1410 nt, Artificial Sequence; identical to SEQ ID NO: 111030
  derived and/or modified sequence opt2 from neuraminidase__InfluenzaA__AHC59056

SEQ ID NO: 115554 - RNA, 1410 nt, Artificial Sequence; identical to SEQ ID NO: 115483
  derived and/or modified sequence opt2 from neuraminidase__InfluenzaA__AHC59068

SEQ ID NO: 115555 - RNA, 1410 nt, Artificial Sequence; identical to SEQ ID NO: 115483
  derived and/or modified sequence opt2 from neuraminidase__InfluenzaA__AHC59080

SEQ ID NO: 115556 - RNA, 1410 nt, Artificial Sequence
  derived and/or modified sequence opt2 from neuraminidase__InfluenzaA__AHC59092
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115557 - RNA, 1410 nt, Artificial Sequence
  derived and/or modified sequence opt2 from neuraminidase__InfluenzaA__AHC59104
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucaagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115558 - RNA, 1410 nt, Artificial Sequence
  derived and/or modified sequence opt2 from neuraminidase__InfluenzaA__AHC59116
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcgaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115559 - RNA, 1410 nt, Artificial Sequence
  derived and/or modified sequence opt2 from neuraminidase__InfluenzaA__AHC59128
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucauggagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115560 - RNA, 1410 nt, Artificial Sequence
  derived and/or modified sequence opt2 from neuraminidase__InfluenzaA__AHC59152
augaaccccaaccagaagaucaucaccaucggcuccgucucccucaccaucuccaccaucugcuucuucaugcaggucgccauccucaucaccaccgucacccuccacuucaagcaguacgaguucaacuccccccccaacaaccaggucaugcucugcgagcccaccaucaucgagcgcaacaucaccgagauccucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115561 - RNA, 1410 nt, Artificial Sequence
  derived and/or modified sequence opt2 from neuraminidase__InfluenzaA__AHC59188
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucguccucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115562 - RNA, 1410 nt, Artificial Sequence; identical to SEQ ID NO: 111030
  derived and/or modified sequence opt2 from neuraminidase__InfluenzaA__AHC59200

SEQ ID NO: 115563 - RNA, 1410 nt, Artificial Sequence
  derived and/or modified sequence opt2 from neuraminidase__InfluenzaA__AHC59212
augaaccccaaccagaagaucaucaccaucggcuccgucucccucaccaucuccaccaucugcuucuucaugcagaucgccacccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115564 - RNA, 1410 nt, Artificial Sequence; identical to SEQ ID NO: 115487
  derived and/or modified sequence opt2 from neuraminidase__InfluenzaA__AHC59224

SEQ ID NO: 115565 - RNA, 1410 nt, Artificial Sequence
  derived and/or modified sequence opt2 from neuraminidase__InfluenzaA__AHC59236
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115566 - RNA, 1410 nt, Artificial Sequence; identical to SEQ ID NO: 115487
  derived and/or modified sequence opt2 from neuraminidase__InfluenzaA__AHC59260

SEQ ID NO: 115567 - RNA, 1410 nt, Artificial Sequence; identical to SEQ ID NO: 115483
  derived and/or modified sequence opt2 from neuraminidase__InfluenzaA__AHC59272

SEQ ID NO: 115568 - RNA, 1410 nt, Artificial Sequence; identical to SEQ ID NO: 115487
  derived and/or modified sequence opt2 from neuraminidase__InfluenzaA__AHC59284

SEQ ID NO: 115569 - RNA, 1410 nt, Artificial Sequence
  derived and/or modified sequence opt2 from neuraminidase__InfluenzaA__AHC59296
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaagaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115570 - RNA, 1410 nt, Artificial Sequence
  derived and/or modified sequence opt2 from neuraminidase__InfluenzaA__AHC59308
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucauggucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115571 - RNA, 1410 nt, Artificial Sequence; identical to SEQ ID NO: 115395
  derived and/or modified sequence opt2 from neuraminidase__InfluenzaA__AHC59320

SEQ ID NO: 115572 - RNA, 1410 nt, Artificial Sequence; identical to SEQ ID NO: 113658
  derived and/or modified sequence opt2 from neuraminidase__InfluenzaA__AHC59332

SEQ ID NO: 115573 - RNA, 1410 nt, Artificial Sequence; identical to SEQ ID NO: 115531
  derived and/or modified sequence opt2 from neuraminidase__InfluenzaA__AHC59344

SEQ ID NO: 115574 - RNA, 1410 nt, Artificial Sequence
  derived and/or modified sequence opt2 from neuraminidase__InfluenzaA__AHC59368
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucgacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115575 - RNA, 1410 nt, Artificial Sequence; identical to SEQ ID NO: 115483
  derived and/or modified sequence opt2 from neuraminidase__InfluenzaA__AHC59380

SEQ ID NO: 115576 - RNA, 1410 nt, Artificial Sequence; identical to SEQ ID NO: 114434
  derived and/or modified sequence opt2 from neuraminidase__InfluenzaA__AHC59392

SEQ ID NO: 115577 - RNA, 1410 nt, Artificial Sequence; identical to SEQ ID NO: 115519
  derived and/or modified sequence opt2 from neuraminidase__InfluenzaA__AHC59404

SEQ ID NO: 115578 - RNA, 1410 nt, Artificial Sequence; identical to SEQ ID NO: 115487
  derived and/or modified sequence opt2 from neuraminidase__InfluenzaA__AHC59416

SEQ ID NO: 115579 - RNA, 1410 nt, Artificial Sequence
  derived and/or modified sequence opt2 from neuraminidase__InfluenzaA__AHC59428
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgaccgcugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115580 - RNA, 1410 nt, Artificial Sequence
  derived and/or modified sequence opt2 from neuraminidase__InfluenzaA__AHC59440
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccagaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115581 - RNA, 1410 nt, Artificial Sequence; identical to SEQ ID NO: 115487
  derived and/or modified sequence opt2 from neuraminidase__InfluenzaA__AHC59452

SEQ ID NO: 115582 - RNA, 1410 nt, Artificial Sequence; identical to SEQ ID NO: 111030
  derived and/or modified sequence opt2 from neuraminidase__InfluenzaA__AHC59464

SEQ ID NO: 115583 - RNA, 1410 nt, Artificial Sequence; identical to SEQ ID NO: 115395
  derived and/or modified sequence opt2 from neuraminidase__InfluenzaA__AHC59476

SEQ ID NO: 115584 - RNA, 1410 nt, Artificial Sequence; identical to SEQ ID NO: 115487
  derived and/or modified sequence opt2 from neuraminidase__InfluenzaA__AHC59488

SEQ ID NO: 115585 - RNA, 1410 nt, Artificial Sequence; identical to SEQ ID NO: 115487
  derived and/or modified sequence opt2 from neuraminidase__InfluenzaA__AHC59500

SEQ ID NO: 115586 - RNA, 1410 nt, Artificial Sequence; identical to SEQ ID NO: 115532
  derived and/or modified sequence opt2 from neuraminidase__InfluenzaA__AHC59512

SEQ ID NO: 115587 - RNA, 1410 nt, Artificial Sequence; identical to SEQ ID NO: 115532
  derived and/or modified sequence opt2 from neuraminidase__InfluenzaA__AHC59524

SEQ ID NO: 115588 - RNA, 1410 nt, Artificial Sequence; identical to SEQ ID NO: 115519
  derived and/or modified sequence opt2 from neuraminidase__InfluenzaA__AHC59536

SEQ ID NO: 115589 - RNA, 1410 nt, Artificial Sequence; identical to SEQ ID NO: 115487
  derived and/or modified sequence opt2 from neuraminidase__InfluenzaA__AHC59548

SEQ ID NO: 115590 - RNA, 1410 nt, Artificial Sequence; identical to SEQ ID NO: 115487
  derived and/or modified sequence opt2 from neuraminidase__InfluenzaA__AHC59560

SEQ ID NO: 115591 - RNA, 1410 nt, Artificial Sequence; identical to SEQ ID NO: 115565
  derived and/or modified sequence opt2 from neuraminidase__InfluenzaA__AHC59572

SEQ ID NO: 115592 - RNA, 1410 nt, Artificial Sequence; identical to SEQ ID NO: 115560
  derived and/or modified sequence opt2 from neuraminidase__InfluenzaA__AHC59584

SEQ ID NO: 115593 - RNA, 1410 nt, Artificial Sequence; identical to SEQ ID NO: 115532
  derived and/or modified sequence opt2 from neuraminidase__InfluenzaA__AHC59596

SEQ ID NO: 115594 - RNA, 1410 nt, Artificial Sequence; identical to SEQ ID NO: 114434
  derived and/or modified sequence opt2 from neuraminidase__InfluenzaA__AHC59608

SEQ ID NO: 115595 - RNA, 1410 nt, Artificial Sequence; identical to SEQ ID NO: 115519
  derived and/or modified sequence opt2 from neuraminidase__InfluenzaA__AHC59620

SEQ ID NO: 115596 - RNA, 1410 nt, Artificial Sequence; identical to SEQ ID NO: 115487
  derived and/or modified sequence opt2 from neuraminidase__InfluenzaA__AHC59632

SEQ ID NO: 115597 - RNA, 1410 nt, Artificial Sequence; identical to SEQ ID NO: 115487
  derived and/or modified sequence opt2 from neuraminidase__InfluenzaA__AHC59644

SEQ ID NO: 115598 - RNA, 1410 nt, Artificial Sequence
  derived and/or modified sequence opt2 from neuraminidase__InfluenzaA__AHC59656
augaaccccaaccagaagaucaucaccaucggcuccgucucccucaccaucuccaccaucugcuucuucaugcagaucgccauccucaucaccaccgucaccaugcacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgucaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115599 - RNA, 1410 nt, Artificial Sequence; identical to SEQ ID NO: 115532
  derived and/or modified sequence opt2 from neuraminidase__InfluenzaA__AHC59668

SEQ ID NO: 115600 - RNA, 1410 nt, Artificial Sequence; identical to SEQ ID NO: 115560
  derived and/or modified sequence opt2 from neuraminidase__InfluenzaA__AHC59680

SEQ ID NO: 115601 - RNA, 1410 nt, Artificial Sequence; identical to SEQ ID NO: 115487
  derived and/or modified sequence opt2 from neuraminidase__InfluenzaA__AHC59704

SEQ ID NO: 115602 - RNA, 1410 nt, Artificial Sequence; identical to SEQ ID NO: 111030
  derived and/or modified sequence opt2 from neuraminidase__InfluenzaA__AHC59716

SEQ ID NO: 115603 - RNA, 1410 nt, Artificial Sequence; identical to SEQ ID NO: 111030
  derived and/or modified sequence opt2 from neuraminidase__InfluenzaA__AHC59728

SEQ ID NO: 115604 - RNA, 1410 nt, Artificial Sequence; identical to SEQ ID NO: 115532
  derived and/or modified sequence opt2 from neuraminidase__InfluenzaA__AHC59752

SEQ ID NO: 115605 - RNA, 1410 nt, Artificial Sequence; identical to SEQ ID NO: 115519
  derived and/or modified sequence opt2 from neuraminidase__InfluenzaA__AHC59764

SEQ ID NO: 115606 - RNA, 1410 nt, Artificial Sequence
  derived and/or modified sequence opt2 from neuraminidase__InfluenzaA__AHC59776
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115607 - RNA, 1410 nt, Artificial Sequence; identical to SEQ ID NO: 115483
  derived and/or modified sequence opt2 from neuraminidase__InfluenzaA__AHC59788

SEQ ID NO: 115608 - RNA, 1410 nt, Artificial Sequence; identical to SEQ ID NO: 115560
  derived and/or modified sequence opt2 from neuraminidase__InfluenzaA__AHC59800

SEQ ID NO: 115609 - RNA, 1410 nt, Artificial Sequence
  derived and/or modified sequence opt2 from neuraminidase__InfluenzaA__AHC59812
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucgucuacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115610 - RNA, 1410 nt, Artificial Sequence
  derived and/or modified sequence opt2 from neuraminidase__InfluenzaA__AHC59824
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115611 - RNA, 1410 nt, Artificial Sequence; identical to SEQ ID NO: 115487
  derived and/or modified sequence opt2 from neuraminidase__InfluenzaA__AHC59836

SEQ ID NO: 115612 - RNA, 1410 nt, Artificial Sequence; identical to SEQ ID NO: 114434
  derived and/or modified sequence opt2 from neuraminidase__InfluenzaA__AHC59848

SEQ ID NO: 115613 - RNA, 1410 nt, Artificial Sequence; identical to SEQ ID NO: 115483
  derived and/or modified sequence opt2 from neuraminidase__InfluenzaA__AHC59860

SEQ ID NO: 115614 - RNA, 1410 nt, Artificial Sequence; identical to SEQ ID NO: 115530
  derived and/or modified sequence opt2 from neuraminidase__InfluenzaA__AHC59872

SEQ ID NO: 115615 - RNA, 1410 nt, Artificial Sequence; identical to SEQ ID NO: 115519
  derived and/or modified sequence opt2 from neuraminidase__InfluenzaA__AHC59884

SEQ ID NO: 115616 - RNA, 1410 nt, Artificial Sequence
  derived and/or modified sequence opt2 from neuraminidase__InfluenzaA__AHC59895
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115617 - RNA, 1410 nt, Artificial Sequence; identical to SEQ ID NO: 115487
  derived and/or modified sequence opt2 from neuraminidase__InfluenzaA__AHC59907

SEQ ID NO: 115618 - RNA, 1410 nt, Artificial Sequence
  derived and/or modified sequence opt2 from neuraminidase__InfluenzaA__AHC59918
augaaccccaaccagaagaucaucaccaucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaugaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115619 - RNA, 1410 nt, Artificial Sequence; identical to SEQ ID NO: 115618
  derived and/or modified sequence opt2 from neuraminidase__InfluenzaA__AHC59930

SEQ ID NO: 115620 - RNA, 1410 nt, Artificial Sequence; identical to SEQ ID NO: 115487
  derived and/or modified sequence opt2 from neuraminidase__InfluenzaA__AHC59942

SEQ ID NO: 115621 - RNA, 1410 nt, Artificial Sequence; identical to SEQ ID NO: 115532
  derived and/or modified sequence opt2 from neuraminidase__InfluenzaA__AHC59954

SEQ ID NO: 115622 - RNA, 1410 nt, Artificial Sequence
  derived and/or modified sequence opt2 from neuraminidase__InfluenzaA__AHC59966
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgacggcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115623 - RNA, 1410 nt, Artificial Sequence; identical to SEQ ID NO: 114434
  derived and/or modified sequence opt2 from neuraminidase__InfluenzaA__AHC59978

SEQ ID NO: 115624 - RNA, 1410 nt, Artificial Sequence; identical to SEQ ID NO: 112396
  derived and/or modified sequence opt2 from neuraminidase__InfluenzaA__AHC59990

SEQ ID NO: 115625 - RNA, 1410 nt, Artificial Sequence; identical to SEQ ID NO: 115532
  derived and/or modified sequence opt2 from neuraminidase__InfluenzaA__AHC60002

SEQ ID NO: 115626 - RNA, 1410 nt, Artificial Sequence; identical to SEQ ID NO: 115487
  derived and/or modified sequence opt2 from neuraminidase__InfluenzaA__AHC60014

SEQ ID NO: 115627 - RNA, 1410 nt, Artificial Sequence; identical to SEQ ID NO: 111030
  derived and/or modified sequence opt2 from neuraminidase__InfluenzaA__AHC60026

SEQ ID NO: 115628 - RNA, 1410 nt, Artificial Sequence; identical to SEQ ID NO: 115483
  derived and/or modified sequence opt2 from neuraminidase__InfluenzaA__AHC60038

SEQ ID NO: 115629 - RNA, 1410 nt, Artificial Sequence; identical to SEQ ID NO: 115483
  derived and/or modified sequence opt2 from neuraminidase__InfluenzaA__AHC60050

SEQ ID NO: 115630 - RNA, 1410 nt, Artificial Sequence
  derived and/or modified sequence opt2 from neuraminidase__InfluenzaA__AHC60062
augaaccccaaccagaagaucaucaccaucggcuccgucucccucaccaucuccaccaucugcuucuucaugcagaucgccauccucaucaccaccgucaccaugcacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115631 - RNA, 1410 nt, Artificial Sequence; identical to SEQ ID NO: 114434
  derived and/or modified sequence opt2 from neuraminidase__InfluenzaA__AHC60074

SEQ ID NO: 115632 - RNA, 1410 nt, Artificial Sequence; identical to SEQ ID NO: 115487
  derived and/or modified sequence opt2 from neuraminidase__InfluenzaA__AHC60086

SEQ ID NO: 115633 - RNA, 1410 nt, Artificial Sequence
  derived and/or modified sequence opt2 from neuraminidase__InfluenzaA__AHC60098
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucgacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115634 - RNA, 1410 nt, Artificial Sequence; identical to SEQ ID NO: 115483
  derived and/or modified sequence opt2 from neuraminidase__InfluenzaA__AHC60110

SEQ ID NO: 115635 - RNA, 1410 nt, Artificial Sequence; identical to SEQ ID NO: 115560
  derived and/or modified sequence opt2 from neuraminidase__InfluenzaA__AHC60122

SEQ ID NO: 115636 - RNA, 1410 nt, Artificial Sequence; identical to SEQ ID NO: 115487
  derived and/or modified sequence opt2 from neuraminidase__InfluenzaA__AHC60134

SEQ ID NO: 115637 - RNA, 1410 nt, Artificial Sequence; identical to SEQ ID NO: 115541
  derived and/or modified sequence opt2 from neuraminidase__InfluenzaA__AHC60146

SEQ ID NO: 115638 - RNA, 1410 nt, Artificial Sequence; identical to SEQ ID NO: 115618
  derived and/or modified sequence opt2 from neuraminidase__InfluenzaA__AHC60158

SEQ ID NO: 115639 - RNA, 1410 nt, Artificial Sequence; identical to SEQ ID NO: 115483
  derived and/or modified sequence opt2 from neuraminidase__InfluenzaA__AHC60182

SEQ ID NO: 115640 - RNA, 1410 nt, Artificial Sequence
  derived and/or modified sequence opt2 from neuraminidase__InfluenzaA__AHC60206
augaaccccaaccagaagaucaucaccaucggcuccgucucccucaccaucuccaucaucugcuucuucaugcaggucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115641 - RNA, 1410 nt, Artificial Sequence; identical to SEQ ID NO: 114434
  derived and/or modified sequence opt2 from neuraminidase__InfluenzaA__AHC60218

SEQ ID NO: 115642 - RNA, 1410 nt, Artificial Sequence; identical to SEQ ID NO: 111030
  derived and/or modified sequence opt2 from neuraminidase__InfluenzaA__AHC60230

SEQ ID NO: 115643 - RNA, 1410 nt, Artificial Sequence; identical to SEQ ID NO: 115483
  derived and/or modified sequence opt2 from neuraminidase__InfluenzaA__AHC60242

SEQ ID NO: 115644 - RNA, 1410 nt, Artificial Sequence; identical to SEQ ID NO: 115483
  derived and/or modified sequence opt2 from neuraminidase__InfluenzaA__AHC60254

SEQ ID NO: 115645 - RNA, 1410 nt, Artificial Sequence; identical to SEQ ID NO: 115483
  derived and/or modified sequence opt2 from neuraminidase__InfluenzaA__AHC60266

SEQ ID NO: 115646 - RNA, 1410 nt, Artificial Sequence; identical to SEQ ID NO: 115532
  derived and/or modified sequence opt2 from neuraminidase__InfluenzaA__AHC60278

SEQ ID NO: 115647 - RNA, 1410 nt, Artificial Sequence; identical to SEQ ID NO: 115483
  derived and/or modified sequence opt2 from neuraminidase__InfluenzaA__AHC60290

SEQ ID NO: 115648 - RNA, 1410 nt, Artificial Sequence
  derived and/or modified sequence opt2 from neuraminidase__InfluenzaA__AHC60302
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115649 - RNA, 1410 nt, Artificial Sequence; identical to SEQ ID NO: 115483
  derived and/or modified sequence opt2 from neuraminidase__InfluenzaA__AHC60314

SEQ ID NO: 115650 - RNA, 1410 nt, Artificial Sequence; identical to SEQ ID NO: 115483
  derived and/or modified sequence opt2 from neuraminidase__InfluenzaA__AHC60326

SEQ ID NO: 115651 - RNA, 1410 nt, Artificial Sequence
  derived and/or modified sequence opt2 from neuraminidase__InfluenzaA__AHC60338
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcgacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115652 - RNA, 1410 nt, Artificial Sequence; identical to SEQ ID NO: 112396
  derived and/or modified sequence opt2 from neuraminidase__InfluenzaA__AHC60350

SEQ ID NO: 115653 - RNA, 1410 nt, Artificial Sequence
  derived and/or modified sequence opt2 from neuraminidase__InfluenzaA__AHC60362
augaaccccaaccagaagaucaucaccaucggcuccgucucccucaccaucuccaccaucugcuucuucaugcaggucgccauccucaucaccaccgucacccuccacuucaagcaguacgaguucaacuccccccccaacaaccaggucaugcucugcaagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115654 - RNA, 1410 nt, Artificial Sequence; identical to SEQ ID NO: 115395
  derived and/or modified sequence opt2 from neuraminidase__InfluenzaA__AHC60374

SEQ ID NO: 115655 - RNA, 1410 nt, Artificial Sequence; identical to SEQ ID NO: 111030
  derived and/or modified sequence opt2 from neuraminidase__InfluenzaA__AHC60386

SEQ ID NO: 115656 - RNA, 1410 nt, Artificial Sequence; identical to SEQ ID NO: 115487
  derived and/or modified sequence opt2 from neuraminidase__InfluenzaA__AHC60398

SEQ ID NO: 115657 - RNA, 1410 nt, Artificial Sequence; identical to SEQ ID NO: 115519
  derived and/or modified sequence opt2 from neuraminidase__InfluenzaA__AHC60410

SEQ ID NO: 115658 - RNA, 1410 nt, Artificial Sequence; identical to SEQ ID NO: 111030
  derived and/or modified sequence opt2 from neuraminidase__InfluenzaA__AHC60422

SEQ ID NO: 115659 - RNA, 1410 nt, Artificial Sequence; identical to SEQ ID NO: 115519
  derived and/or modified sequence opt2 from neuraminidase__InfluenzaA__AHC60434

SEQ ID NO: 115660 - RNA, 1410 nt, Artificial Sequence; identical to SEQ ID NO: 115487
  derived and/or modified sequence opt2 from neuraminidase__InfluenzaA__AHC60446

SEQ ID NO: 115661 - RNA, 1410 nt, Artificial Sequence
  derived and/or modified sequence opt2 from neuraminidase__InfluenzaA__AHC60458
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacggcuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115662 - RNA, 1410 nt, Artificial Sequence; identical to SEQ ID NO: 115532
  derived and/or modified sequence opt2 from neuraminidase__InfluenzaA__AHC60470

SEQ ID NO: 115663 - RNA, 1410 nt, Artificial Sequence
  derived and/or modified sequence opt2 from neuraminidase__InfluenzaA__AHC60482
augaaccccaaccagaagaucaucaccaucggcuccgucucccucaccaucuccaccaucugcuucuucaugcagaucgccauccucaccaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115664 - RNA, 1410 nt, Artificial Sequence; identical to SEQ ID NO: 115483
  derived and/or modified sequence opt2 from neuraminidase__InfluenzaA__AHC60494

SEQ ID NO: 115665 - RNA, 1410 nt, Artificial Sequence; identical to SEQ ID NO: 115483
  derived and/or modified sequence opt2 from neuraminidase__InfluenzaA__AHC60506

SEQ ID NO: 115666 - RNA, 1410 nt, Artificial Sequence; identical to SEQ ID NO: 115487
  derived and/or modified sequence opt2 from neuraminidase__InfluenzaA__AHC60518

SEQ ID NO: 115667 - RNA, 1410 nt, Artificial Sequence; identical to SEQ ID NO: 115487
  derived and/or modified sequence opt2 from neuraminidase__InfluenzaA__AHC60542

SEQ ID NO: 115668 - RNA, 1410 nt, Artificial Sequence
  derived and/or modified sequence opt2 from neuraminidase__InfluenzaA__AHC60554
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaugaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcaccuggcccgacggcgccgaccucaaccucaugcccaucuga

SEQ ID NO: 115669 - RNA, 1410 nt, Artificial Sequence
  derived and/or modified sequence opt2 from neuraminidase__InfluenzaA__AHC60566
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccaggucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115670 - RNA, 1410 nt, Artificial Sequence; identical to SEQ ID NO: 114434
  derived and/or modified sequence opt2 from neuraminidase__InfluenzaA__AHC60578

SEQ ID NO: 115671 - RNA, 1410 nt, Artificial Sequence; identical to SEQ ID NO: 115483
  derived and/or modified sequence opt2 from neuraminidase__InfluenzaA__AHC60590

SEQ ID NO: 115672 - RNA, 1410 nt, Artificial Sequence
  derived and/or modified sequence opt2 from neuraminidase__InfluenzaA__AHC60602
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucguccucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115673 - RNA, 1410 nt, Artificial Sequence; identical to SEQ ID NO: 111030
  derived and/or modified sequence opt2 from neuraminidase__InfluenzaA__AHC60614

SEQ ID NO: 115674 - RNA, 1410 nt, Artificial Sequence; identical to SEQ ID NO: 114434
  derived and/or modified sequence opt2 from neuraminidase__InfluenzaA__AHC60626

SEQ ID NO: 115675 - RNA, 1410 nt, Artificial Sequence
  derived and/or modified sequence opt2 from neuraminidase__InfluenzaA__AHC60650
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacgagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115676 - RNA, 1410 nt, Artificial Sequence; identical to SEQ ID NO: 115532
  derived and/or modified sequence opt2 from neuraminidase__InfluenzaA__AHC60662

SEQ ID NO: 115677 - RNA, 1410 nt, Artificial Sequence; identical to SEQ ID NO: 115487
  derived and/or modified sequence opt2 from neuraminidase__InfluenzaA__AHC60674

SEQ ID NO: 115678 - RNA, 1410 nt, Artificial Sequence; identical to SEQ ID NO: 111030
  derived and/or modified sequence opt2 from neuraminidase__InfluenzaA__AHC60686

SEQ ID NO: 115679 - RNA, 1410 nt, Artificial Sequence; identical to SEQ ID NO: 115487
  derived and/or modified sequence opt2 from neuraminidase__InfluenzaA__AHC60698

SEQ ID NO: 115680 - RNA, 1410 nt, Artificial Sequence; identical to SEQ ID NO: 115483
  derived and/or modified sequence opt2 from neuraminidase__InfluenzaA__AHC60710

SEQ ID NO: 115681 - RNA, 1410 nt, Artificial Sequence; identical to SEQ ID NO: 115532
  derived and/or modified sequence opt2 from neuraminidase__InfluenzaA__AHC60722

SEQ ID NO: 115682 - RNA, 1410 nt, Artificial Sequence
  derived and/or modified sequence opt2 from neuraminidase__InfluenzaA__AHC60734
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaucaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115683 - RNA, 1410 nt, Artificial Sequence; identical to SEQ ID NO: 115519
  derived and/or modified sequence opt2 from neuraminidase__InfluenzaA__AHC60746

SEQ ID NO: 115684 - RNA, 1410 nt, Artificial Sequence; identical to SEQ ID NO: 115618
  derived and/or modified sequence opt2 from neuraminidase__InfluenzaA__AHC60770

SEQ ID NO: 115685 - RNA, 1410 nt, Artificial Sequence
  derived and/or modified sequence opt2 from neuraminidase__InfluenzaA__AHC60782
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccggcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115686 - RNA, 1410 nt, Artificial Sequence; identical to SEQ ID NO: 115530
  derived and/or modified sequence opt2 from neuraminidase__InfluenzaA__AHC60794

SEQ ID NO: 115687 - RNA, 1410 nt, Artificial Sequence
  derived and/or modified sequence opt2 from neuraminidase__InfluenzaA__AHC60806
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccggcguccucuggaccuccaacuccaucgucgucuucugcggcaccuccggcaccuacggcaccggcuccuggcccgacggcgccgaccucaaccucaugcccaucuga

SEQ ID NO: 115688 - RNA, 1410 nt, Artificial Sequence; identical to SEQ ID NO: 112396
  derived and/or modified sequence opt2 from neuraminidase__InfluenzaA__AHC60818

SEQ ID NO: 115689 - RNA, 1410 nt, Artificial Sequence; identical to SEQ ID NO: 115487
  derived and/or modified sequence opt2 from neuraminidase__InfluenzaA__AHC60830

SEQ ID NO: 115690 - RNA, 1410 nt, Artificial Sequence; identical to SEQ ID NO: 115668
  derived and/or modified sequence opt2 from neuraminidase__InfluenzaA__AHC60842

SEQ ID NO: 115691 - RNA, 1410 nt, Artificial Sequence; identical to SEQ ID NO: 115487
  derived and/or modified sequence opt2 from neuraminidase__InfluenzaA__AHC60854

SEQ ID NO: 115692 - RNA, 1410 nt, Artificial Sequence; identical to SEQ ID NO: 115532
  derived and/or modified sequence opt2 from neuraminidase__InfluenzaA__AHC60866

SEQ ID NO: 115693 - RNA, 1410 nt, Artificial Sequence; identical to SEQ ID NO: 115519
  derived and/or modified sequence opt2 from neuraminidase__InfluenzaA__AHC60878

SEQ ID NO: 115694 - RNA, 1410 nt, Artificial Sequence; identical to SEQ ID NO: 115519
  derived and/or modified sequence opt2 from neuraminidase__InfluenzaA__AHC60890

SEQ ID NO: 115695 - RNA, 1410 nt, Artificial Sequence; identical to SEQ ID NO: 115618
  derived and/or modified sequence opt2 from neuraminidase__InfluenzaA__AHC60902

SEQ ID NO: 115696 - RNA, 1410 nt, Artificial Sequence; identical to SEQ ID NO: 115483
  derived and/or modified sequence opt2 from neuraminidase__InfluenzaA__AHC60914

SEQ ID NO: 115697 - RNA, 1410 nt, Artificial Sequence; identical to SEQ ID NO: 115487
  derived and/or modified sequence opt2 from neuraminidase__InfluenzaA__AHC60926

SEQ ID NO: 115698 - RNA, 1410 nt, Artificial Sequence; identical to SEQ ID NO: 115483
  derived and/or modified sequence opt2 from neuraminidase__InfluenzaA__AHC60938

SEQ ID NO: 115699 - RNA, 1410 nt, Artificial Sequence; identical to SEQ ID NO: 115487
  derived and/or modified sequence opt2 from neuraminidase__InfluenzaA__AHC60950

SEQ ID NO: 115700 - RNA, 1410 nt, Artificial Sequence
  derived and/or modified sequence opt2 from neuraminidase__InfluenzaA__AHC60962
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115701 - RNA, 1410 nt, Artificial Sequence; identical to SEQ ID NO: 115532
  derived and/or modified sequence opt2 from neuraminidase__InfluenzaA__AHC60974

SEQ ID NO: 115702 - RNA, 1410 nt, Artificial Sequence; identical to SEQ ID NO: 115483
  derived and/or modified sequence opt2 from neuraminidase__InfluenzaA__AHC60986

SEQ ID NO: 115703 - RNA, 1410 nt, Artificial Sequence; identical to SEQ ID NO: 115630
  derived and/or modified sequence opt2 from neuraminidase__InfluenzaA__AHC60998

SEQ ID NO: 115704 - RNA, 1410 nt, Artificial Sequence; identical to SEQ ID NO: 115530
  derived and/or modified sequence opt2 from neuraminidase__InfluenzaA__AHC61010

SEQ ID NO: 115705 - RNA, 1410 nt, Artificial Sequence
  derived and/or modified sequence opt2 from neuraminidase__InfluenzaA__AHC61022
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccaucucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115706 - RNA, 1410 nt, Artificial Sequence; identical to SEQ ID NO: 111030
  derived and/or modified sequence opt2 from neuraminidase__InfluenzaA__AHC61034

SEQ ID NO: 115707 - RNA, 1410 nt, Artificial Sequence; identical to SEQ ID NO: 115483
  derived and/or modified sequence opt2 from neuraminidase__InfluenzaA__AHC61046

SEQ ID NO: 115708 - RNA, 1410 nt, Artificial Sequence; identical to SEQ ID NO: 115532
  derived and/or modified sequence opt2 from neuraminidase__InfluenzaA__AHC61058

SEQ ID NO: 115709 - RNA, 1410 nt, Artificial Sequence; identical to SEQ ID NO: 115395
  derived and/or modified sequence opt2 from neuraminidase__InfluenzaA__AHC61070

SEQ ID NO: 115710 - RNA, 1410 nt, Artificial Sequence
  derived and/or modified sequence opt2 from neuraminidase__InfluenzaA__AHC61082
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccggcguccucuggaccuccaacuccaucgucgucuucugcggcaccuccggcaccuacggcaccggcuccuggcccgacggcgccgaccucaaccucaugcccaucuga

SEQ ID NO: 115711 - RNA, 1410 nt, Artificial Sequence; identical to SEQ ID NO: 111030
  derived and/or modified sequence opt2 from neuraminidase__InfluenzaA__AHC61094

SEQ ID NO: 115712 - RNA, 1410 nt, Artificial Sequence; identical to SEQ ID NO: 115519
  derived and/or modified sequence opt2 from neuraminidase__InfluenzaA__AHC61106

SEQ ID NO: 115713 - RNA, 1410 nt, Artificial Sequence; identical to SEQ ID NO: 115519
  derived and/or modified sequence opt2 from neuraminidase__InfluenzaA__AHC61118

SEQ ID NO: 115714 - RNA, 1410 nt, Artificial Sequence; identical to SEQ ID NO: 115483
  derived and/or modified sequence opt2 from neuraminidase__InfluenzaA__AHC61130

SEQ ID NO: 115715 - RNA, 1410 nt, Artificial Sequence; identical to SEQ ID NO: 115630
  derived and/or modified sequence opt2 from neuraminidase__InfluenzaA__AHC61142

SEQ ID NO: 115716 - RNA, 1410 nt, Artificial Sequence; identical to SEQ ID NO: 115519
  derived and/or modified sequence opt2 from neuraminidase__InfluenzaA__AHC61154

SEQ ID NO: 115717 - RNA, 1410 nt, Artificial Sequence
  derived and/or modified sequence opt2 from neuraminidase__InfluenzaA__AHC61166
augaaccccaaccagaagaucaucaccaucggcuccgucucccucaccaucuccaccaucugcuucuucaugcaggucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115718 - RNA, 1410 nt, Artificial Sequence; identical to SEQ ID NO: 115483
  derived and/or modified sequence opt2 from neuraminidase__InfluenzaA__AHC61178

SEQ ID NO: 115719 - RNA, 1410 nt, Artificial Sequence; identical to SEQ ID NO: 115519
  derived and/or modified sequence opt2 from neuraminidase__InfluenzaA__AHC61190

SEQ ID NO: 115720 - RNA, 1410 nt, Artificial Sequence; identical to SEQ ID NO: 115532
  derived and/or modified sequence opt2 from neuraminidase__InfluenzaA__AHC61202

SEQ ID NO: 115721 - RNA, 1410 nt, Artificial Sequence; identical to SEQ ID NO: 115487
  derived and/or modified sequence opt2 from neuraminidase__InfluenzaA__AHC61214

SEQ ID NO: 115722 - RNA, 1410 nt, Artificial Sequence; identical to SEQ ID NO: 115532
  derived and/or modified sequence opt2 from neuraminidase__InfluenzaA__AHC61226

SEQ ID NO: 115723 - RNA, 1410 nt, Artificial Sequence; identical to SEQ ID NO: 115519
  derived and/or modified sequence opt2 from neuraminidase__InfluenzaA__AHC61238

SEQ ID NO: 115724 - RNA, 1410 nt, Artificial Sequence; identical to SEQ ID NO: 115700
  derived and/or modified sequence opt2 from neuraminidase__InfluenzaA__AHC61250

SEQ ID NO: 115725 - RNA, 1410 nt, Artificial Sequence; identical to SEQ ID NO: 115483
  derived and/or modified sequence opt2 from neuraminidase__InfluenzaA__AHC61262

SEQ ID NO: 115726 - RNA, 1410 nt, Artificial Sequence; identical to SEQ ID NO: 115487
  derived and/or modified sequence opt2 from neuraminidase__InfluenzaA__AHC61274

SEQ ID NO: 115727 - RNA, 1410 nt, Artificial Sequence; identical to SEQ ID NO: 111030
  derived and/or modified sequence opt2 from neuraminidase__InfluenzaA__AHC61286

SEQ ID NO: 115728 - RNA, 1410 nt, Artificial Sequence; identical to SEQ ID NO: 115531
  derived and/or modified sequence opt2 from neuraminidase__InfluenzaA__AHC61298

SEQ ID NO: 115729 - RNA, 1410 nt, Artificial Sequence
  derived and/or modified sequence opt2 from neuraminidase__InfluenzaA__AHC61310
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucaucgaccgcggcaaccgcuccggcuacuccggcaucuucuccgucgagggcaaguccugcaucaaccgcugcuucuacgucgagcucauccgcggccgcaaggaggagaccgagguccucuggaccuccuccuccaucgucgucuucugcggcaccuccggcaccuacggcaccggcuccuggcccgacggcgccgaccucaaccucaugcccaucuga

SEQ ID NO: 115730 - RNA, 1410 nt, Artificial Sequence; identical to SEQ ID NO: 115560
  derived and/or modified sequence opt2 from neuraminidase__InfluenzaA__AHC61322

SEQ ID NO: 115731 - RNA, 1410 nt, Artificial Sequence; identical to SEQ ID NO: 115519
  derived and/or modified sequence opt2 from neuraminidase__InfluenzaA__AHC61334

SEQ ID NO: 115732 - RNA, 1410 nt, Artificial Sequence; identical to SEQ ID NO: 115487
  derived and/or modified sequence opt2 from neuraminidase__InfluenzaA__AHC61346

SEQ ID NO: 115733 - RNA, 1410 nt, Artificial Sequence
  derived and/or modified sequence opt2 from neuraminidase__InfluenzaA__AHC61358
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacaucuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucaagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115734 - RNA, 1410 nt, Artificial Sequence; identical to SEQ ID NO: 115532
  derived and/or modified sequence opt2 from neuraminidase__InfluenzaA__AHC61370

SEQ ID NO: 115735 - RNA, 1410 nt, Artificial Sequence; identical to SEQ ID NO: 115560
  derived and/or modified sequence opt2 from neuraminidase__InfluenzaA__AHC61382

SEQ ID NO: 115736 - RNA, 1410 nt, Artificial Sequence; identical to SEQ ID NO: 115532
  derived and/or modified sequence opt2 from neuraminidase__InfluenzaA__AHC61394

SEQ ID NO: 115737 - RNA, 1410 nt, Artificial Sequence; identical to SEQ ID NO: 115560
  derived and/or modified sequence opt2 from neuraminidase__InfluenzaA__AHC61406

SEQ ID NO: 115738 - RNA, 1410 nt, Artificial Sequence; identical to SEQ ID NO: 115519
  derived and/or modified sequence opt2 from neuraminidase__InfluenzaA__AHC61418

SEQ ID NO: 115739 - RNA, 1410 nt, Artificial Sequence; identical to SEQ ID NO: 111030
  derived and/or modified sequence opt2 from neuraminidase__InfluenzaA__AHC61430

SEQ ID NO: 115740 - RNA, 1410 nt, Artificial Sequence; identical to SEQ ID NO: 115532
  derived and/or modified sequence opt2 from neuraminidase__InfluenzaA__AHC61442

SEQ ID NO: 115741 - RNA, 1410 nt, Artificial Sequence; identical to SEQ ID NO: 115532
  derived and/or modified sequence opt2 from neuraminidase__InfluenzaA__AHC61454

SEQ ID NO: 115742 - RNA, 1410 nt, Artificial Sequence
  derived and/or modified sequence opt2 from neuraminidase__InfluenzaA__AHC61466
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaccaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115743 - RNA, 1410 nt, Artificial Sequence; identical to SEQ ID NO: 115483
  derived and/or modified sequence opt2 from neuraminidase__InfluenzaA__AHC61478

SEQ ID NO: 115744 - RNA, 1410 nt, Artificial Sequence; identical to SEQ ID NO: 115519
  derived and/or modified sequence opt2 from neuraminidase__InfluenzaA__AHC61490

SEQ ID NO: 115745 - RNA, 1410 nt, Artificial Sequence; identical to SEQ ID NO: 115483
  derived and/or modified sequence opt2 from neuraminidase__InfluenzaA__AHC61502

SEQ ID NO: 115746 - RNA, 1410 nt, Artificial Sequence; identical to SEQ ID NO: 115532
  derived and/or modified sequence opt2 from neuraminidase__InfluenzaA__AHC61514

SEQ ID NO: 115747 - RNA, 1410 nt, Artificial Sequence; identical to SEQ ID NO: 114434
  derived and/or modified sequence opt2 from neuraminidase__InfluenzaA__AHC61526

SEQ ID NO: 115748 - RNA, 1410 nt, Artificial Sequence
  derived and/or modified sequence opt2 from neuraminidase__InfluenzaA__AHC61538
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcucccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115749 - RNA, 1410 nt, Artificial Sequence; identical to SEQ ID NO: 115532
  derived and/or modified sequence opt2 from neuraminidase__InfluenzaA__AHC61550

SEQ ID NO: 115750 - RNA, 1410 nt, Artificial Sequence
  derived and/or modified sequence opt2 from neuraminidase__InfluenzaA__AHC61562
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaugaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgaguccaaguccugcaucaaccgcugcuucuacgucgagcucauccgcggccgcaaggaggagaccgagguccucuggaccuccaacuccaucgucgucuucugcggcaccuccggcaccuacggcaccggcaccuggcccgacggcgccgaccucaaccucaugcccaucuga

SEQ ID NO: 115751 - RNA, 1410 nt, Artificial Sequence; identical to SEQ ID NO: 115531
  derived and/or modified sequence opt2 from neuraminidase__InfluenzaA__AHC61574

SEQ ID NO: 115752 - RNA, 1410 nt, Artificial Sequence; identical to SEQ ID NO: 115532
  derived and/or modified sequence opt2 from neuraminidase__InfluenzaA__AHC61586

SEQ ID NO: 115753 - RNA, 1410 nt, Artificial Sequence; identical to SEQ ID NO: 114434
  derived and/or modified sequence opt2 from neuraminidase__InfluenzaA__AHC61598

SEQ ID NO: 115754 - RNA, 1410 nt, Artificial Sequence; identical to SEQ ID NO: 115483
  derived and/or modified sequence opt2 from neuraminidase__InfluenzaA__AHC61610

SEQ ID NO: 115755 - RNA, 1410 nt, Artificial Sequence; identical to SEQ ID NO: 115531
  derived and/or modified sequence opt2 from neuraminidase__InfluenzaA__AHC61622

SEQ ID NO: 115756 - RNA, 1410 nt, Artificial Sequence; identical to SEQ ID NO: 111030
  derived and/or modified sequence opt2 from neuraminidase__InfluenzaA__AHC61634

SEQ ID NO: 115757 - RNA, 1410 nt, Artificial Sequence; identical to SEQ ID NO: 111030
  derived and/or modified sequence opt2 from neuraminidase__InfluenzaA__AHC61646

SEQ ID NO: 115758 - RNA, 1410 nt, Artificial Sequence; identical to SEQ ID NO: 111030
  derived and/or modified sequence opt2 from neuraminidase__InfluenzaA__AHC61658

SEQ ID NO: 115759 - RNA, 1410 nt, Artificial Sequence; identical to SEQ ID NO: 114434
  derived and/or modified sequence opt2 from neuraminidase__InfluenzaA__AHC61670

SEQ ID NO: 115760 - RNA, 1410 nt, Artificial Sequence; identical to SEQ ID NO: 115487
  derived and/or modified sequence opt2 from neuraminidase__InfluenzaA__AHC61682

SEQ ID NO: 115761 - RNA, 1410 nt, Artificial Sequence; identical to SEQ ID NO: 114434
  derived and/or modified sequence opt2 from neuraminidase__InfluenzaA__AHC61694

SEQ ID NO: 115762 - RNA, 1410 nt, Artificial Sequence
  derived and/or modified sequence opt2 from neuraminidase__InfluenzaA__AHC61706
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggagcacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115763 - RNA, 1410 nt, Artificial Sequence
  derived and/or modified sequence opt2 from neuraminidase__InfluenzaA__AHC61718
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucaccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccggcguccucuggaccuccaacuccaucgucgucuucugcggcaccuccggcaccuacggcaccggcuccuggcccgacggcgccgaccucaaccucaugcccaucuga

SEQ ID NO: 115764 - RNA, 1410 nt, Artificial Sequence; identical to SEQ ID NO: 115483
  derived and/or modified sequence opt2 from neuraminidase__InfluenzaA__AHC61730

SEQ ID NO: 115765 - RNA, 1410 nt, Artificial Sequence; identical to SEQ ID NO: 115532
  derived and/or modified sequence opt2 from neuraminidase__InfluenzaA__AHC61742

SEQ ID NO: 115766 - RNA, 1410 nt, Artificial Sequence; identical to SEQ ID NO: 115483
  derived and/or modified sequence opt2 from neuraminidase__InfluenzaA__AHC61754

SEQ ID NO: 115767 - RNA, 1410 nt, Artificial Sequence; identical to SEQ ID NO: 111030
  derived and/or modified sequence opt2 from neuraminidase__InfluenzaA__AHC61766

SEQ ID NO: 115768 - RNA, 1410 nt, Artificial Sequence; identical to SEQ ID NO: 115519
  derived and/or modified sequence opt2 from neuraminidase__InfluenzaA__AHC61778

SEQ ID NO: 115769 - RNA, 1410 nt, Artificial Sequence; identical to SEQ ID NO: 115557
  derived and/or modified sequence opt2 from neuraminidase__InfluenzaA__AHC61790

SEQ ID NO: 115770 - RNA, 1410 nt, Artificial Sequence; identical to SEQ ID NO: 115487
  derived and/or modified sequence opt2 from neuraminidase__InfluenzaA__AHC61802

SEQ ID NO: 115771 - RNA, 1410 nt, Artificial Sequence; identical to SEQ ID NO: 115483
  derived and/or modified sequence opt2 from neuraminidase__InfluenzaA__AHC61814

SEQ ID NO: 115772 - RNA, 1410 nt, Artificial Sequence
  derived and/or modified sequence opt2 from neuraminidase__InfluenzaA__AHC61826
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115773 - RNA, 1410 nt, Artificial Sequence; identical to SEQ ID NO: 115483
  derived and/or modified sequence opt2 from neuraminidase__InfluenzaA__AHC61838

SEQ ID NO: 115774 - RNA, 1410 nt, Artificial Sequence; identical to SEQ ID NO: 115519
  derived and/or modified sequence opt2 from neuraminidase__InfluenzaA__AHC61850

SEQ ID NO: 115775 - RNA, 1410 nt, Artificial Sequence; identical to SEQ ID NO: 115532
  derived and/or modified sequence opt2 from neuraminidase__InfluenzaA__AHC61862

SEQ ID NO: 115776 - RNA, 1410 nt, Artificial Sequence; identical to SEQ ID NO: 115483
  derived and/or modified sequence opt2 from neuraminidase__InfluenzaA__AHC61874

SEQ ID NO: 115777 - RNA, 1410 nt, Artificial Sequence
  derived and/or modified sequence opt2 from neuraminidase__InfluenzaA__AHC61886
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucguccucugcgagcccaccaucaucgagcgcaacaucaccgagaucgucuaccucaccaacaccaccaucgagaaggagaucugccccaagcccgccgaguaccgccacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115778 - RNA, 1410 nt, Artificial Sequence; identical to SEQ ID NO: 115487
  derived and/or modified sequence opt2 from neuraminidase__InfluenzaA__AHC61898

SEQ ID NO: 115779 - RNA, 1410 nt, Artificial Sequence; identical to SEQ ID NO: 115519
  derived and/or modified sequence opt2 from neuraminidase__InfluenzaA__AHC61910

SEQ ID NO: 115780 - RNA, 1410 nt, Artificial Sequence; identical to SEQ ID NO: 111030
  derived and/or modified sequence opt2 from neuraminidase__InfluenzaA__AHC61934

SEQ ID NO: 115781 - RNA, 1410 nt, Artificial Sequence
  derived and/or modified sequence opt2 from neuraminidase__InfluenzaA__AHC61946
augaaccccaaccagaagaucaucaccaucggcuccgucucccucaccaucuccaccaucugcuucuucaugcagaucgccauccucaucaccaccgucacccuccacuucaagcaguacgaguccuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcaaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115782 - RNA, 1410 nt, Artificial Sequence; identical to SEQ ID NO: 114434
  derived and/or modified sequence opt2 from neuraminidase__InfluenzaA__AHC61958

SEQ ID NO: 115783 - RNA, 1410 nt, Artificial Sequence; identical to SEQ ID NO: 115483
  derived and/or modified sequence opt2 from neuraminidase__InfluenzaA__AHC61970

SEQ ID NO: 115784 - RNA, 1410 nt, Artificial Sequence
  derived and/or modified sequence opt2 from neuraminidase__InfluenzaA__AHC61982
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacggcaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115785 - RNA, 1410 nt, Artificial Sequence; identical to SEQ ID NO: 115487
  derived and/or modified sequence opt2 from neuraminidase__InfluenzaA__AHC61994

SEQ ID NO: 115786 - RNA, 1410 nt, Artificial Sequence; identical to SEQ ID NO: 115519
  derived and/or modified sequence opt2 from neuraminidase__InfluenzaA__AHC62006

SEQ ID NO: 115787 - RNA, 1410 nt, Artificial Sequence; identical to SEQ ID NO: 115483
  derived and/or modified sequence opt2 from neuraminidase__InfluenzaA__AHC62018

SEQ ID NO: 115788 - RNA, 1410 nt, Artificial Sequence; identical to SEQ ID NO: 114434
  derived and/or modified sequence opt2 from neuraminidase__InfluenzaA__AHC62030

SEQ ID NO: 115789 - RNA, 1410 nt, Artificial Sequence; identical to SEQ ID NO: 115487
  derived and/or modified sequence opt2 from neuraminidase__InfluenzaA__AHC62042

SEQ ID NO: 115790 - RNA, 1410 nt, Artificial Sequence; identical to SEQ ID NO: 115560
  derived and/or modified sequence opt2 from neuraminidase__InfluenzaA__AHC62053

SEQ ID NO: 115791 - RNA, 1410 nt, Artificial Sequence
  derived and/or modified sequence opt2 from neuraminidase__InfluenzaA__AHC62065
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115792 - RNA, 1410 nt, Artificial Sequence; identical to SEQ ID NO: 115618
  derived and/or modified sequence opt2 from neuraminidase__InfluenzaA__AHC62077

SEQ ID NO: 115793 - RNA, 1410 nt, Artificial Sequence; identical to SEQ ID NO: 115532
  derived and/or modified sequence opt2 from neuraminidase__InfluenzaA__AHC62089

SEQ ID NO: 115794 - RNA, 1410 nt, Artificial Sequence; identical to SEQ ID NO: 115483
  derived and/or modified sequence opt2 from neuraminidase__InfluenzaA__AHC62101

SEQ ID NO: 115795 - RNA, 1410 nt, Artificial Sequence; identical to SEQ ID NO: 115532
  derived and/or modified sequence opt2 from neuraminidase__InfluenzaA__AHC62113

SEQ ID NO: 115796 - RNA, 1410 nt, Artificial Sequence
  derived and/or modified sequence opt2 from neuraminidase__InfluenzaA__AHC62125
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaacaaguccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115797 - RNA, 1410 nt, Artificial Sequence
  derived and/or modified sequence opt2 from neuraminidase__InfluenzaA__AHC62137
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115798 - RNA, 1410 nt, Artificial Sequence
  derived and/or modified sequence opt2 from neuraminidase__InfluenzaA__AHC62149
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacauccgcgaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115799 - RNA, 1410 nt, Artificial Sequence; identical to SEQ ID NO: 115519
  derived and/or modified sequence opt2 from neuraminidase__InfluenzaA__AHC62161

SEQ ID NO: 115800 - RNA, 1410 nt, Artificial Sequence
  derived and/or modified sequence opt2 from neuraminidase__InfluenzaA__AHC62173
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115801 - RNA, 1410 nt, Artificial Sequence; identical to SEQ ID NO: 115532
  derived and/or modified sequence opt2 from neuraminidase__InfluenzaA__AHC62185

SEQ ID NO: 115802 - RNA, 1410 nt, Artificial Sequence; identical to SEQ ID NO: 114434
  derived and/or modified sequence opt2 from neuraminidase__InfluenzaA__AHC62197

SEQ ID NO: 115803 - RNA, 1410 nt, Artificial Sequence
  derived and/or modified sequence opt2 from neuraminidase__InfluenzaA__AHC62209
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115804 - RNA, 1410 nt, Artificial Sequence; identical to SEQ ID NO: 115487
  derived and/or modified sequence opt2 from neuraminidase__InfluenzaA__AHC62221

SEQ ID NO: 115805 - RNA, 1410 nt, Artificial Sequence; identical to SEQ ID NO: 111030
  derived and/or modified sequence opt2 from neuraminidase__InfluenzaA__AHC62233

SEQ ID NO: 115806 - RNA, 1410 nt, Artificial Sequence; identical to SEQ ID NO: 115483
  derived and/or modified sequence opt2 from neuraminidase__InfluenzaA__AHC62245

SEQ ID NO: 115807 - RNA, 1410 nt, Artificial Sequence
  derived and/or modified sequence opt2 from neuraminidase__InfluenzaA__AHC62257
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucggccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115808 - RNA, 1410 nt, Artificial Sequence; identical to SEQ ID NO: 115560
  derived and/or modified sequence opt2 from neuraminidase__InfluenzaA__AHC62269

SEQ ID NO: 115809 - RNA, 1410 nt, Artificial Sequence; identical to SEQ ID NO: 115532
  derived and/or modified sequence opt2 from neuraminidase__InfluenzaA__AHC62281

SEQ ID NO: 115810 - RNA, 1410 nt, Artificial Sequence; identical to SEQ ID NO: 115487
  derived and/or modified sequence opt2 from neuraminidase__InfluenzaA__AHC62293

SEQ ID NO: 115811 - RNA, 1410 nt, Artificial Sequence; identical to SEQ ID NO: 111030
  derived and/or modified sequence opt2 from neuraminidase__InfluenzaA__AHC62305

SEQ ID NO: 115812 - RNA, 1410 nt, Artificial Sequence; identical to SEQ ID NO: 115483
  derived and/or modified sequence opt2 from neuraminidase__InfluenzaA__AHC62317

SEQ ID NO: 115813 - RNA, 1410 nt, Artificial Sequence
  derived and/or modified sequence opt2 from neuraminidase__InfluenzaA__AHC62329
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgccgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115814 - RNA, 1410 nt, Artificial Sequence; identical to SEQ ID NO: 115483
  derived and/or modified sequence opt2 from neuraminidase__InfluenzaA__AHC62341

SEQ ID NO: 115815 - RNA, 1410 nt, Artificial Sequence
  derived and/or modified sequence opt2 from neuraminidase__InfluenzaA__AHC62353
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115816 - RNA, 1410 nt, Artificial Sequence; identical to SEQ ID NO: 115483
  derived and/or modified sequence opt2 from neuraminidase__InfluenzaA__AHC62365

SEQ ID NO: 115817 - RNA, 1410 nt, Artificial Sequence; identical to SEQ ID NO: 115700
  derived and/or modified sequence opt2 from neuraminidase__InfluenzaA__AHC62377

SEQ ID NO: 115818 - RNA, 1410 nt, Artificial Sequence; identical to SEQ ID NO: 115532
  derived and/or modified sequence opt2 from neuraminidase__InfluenzaA__AHC62389

SEQ ID NO: 115819 - RNA, 1410 nt, Artificial Sequence; identical to SEQ ID NO: 115532
  derived and/or modified sequence opt2 from neuraminidase__InfluenzaA__AHC62401

SEQ ID NO: 115820 - RNA, 1410 nt, Artificial Sequence; identical to SEQ ID NO: 115560
  derived and/or modified sequence opt2 from neuraminidase__InfluenzaA__AHC62413

SEQ ID NO: 115821 - RNA, 1410 nt, Artificial Sequence; identical to SEQ ID NO: 115618
  derived and/or modified sequence opt2 from neuraminidase__InfluenzaA__AHC62425

SEQ ID NO: 115822 - RNA, 1410 nt, Artificial Sequence; identical to SEQ ID NO: 111030
  derived and/or modified sequence opt2 from neuraminidase__InfluenzaA__AHC62437

SEQ ID NO: 115823 - RNA, 1410 nt, Artificial Sequence; identical to SEQ ID NO: 115532
  derived and/or modified sequence opt2 from neuraminidase__InfluenzaA__AHC62449

SEQ ID NO: 115824 - RNA, 1410 nt, Artificial Sequence; identical to SEQ ID NO: 115487
  derived and/or modified sequence opt2 from neuraminidase__InfluenzaA__AHC62461

SEQ ID NO: 115825 - RNA, 1410 nt, Artificial Sequence; identical to SEQ ID NO: 115483
  derived and/or modified sequence opt2 from neuraminidase__InfluenzaA__AHC62473

SEQ ID NO: 115826 - RNA, 1410 nt, Artificial Sequence; identical to SEQ ID NO: 113658
  derived and/or modified sequence opt2 from neuraminidase__InfluenzaA__AHC62485

SEQ ID NO: 115827 - RNA, 1410 nt, Artificial Sequence; identical to SEQ ID NO: 115532
  derived and/or modified sequence opt2 from neuraminidase__InfluenzaA__AHC62509

SEQ ID NO: 115828 - RNA, 1410 nt, Artificial Sequence
  derived and/or modified sequence opt2 from neuraminidase__InfluenzaA__AHC62521
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucaucgucuucugcggcaccuccggcaccuacggcaccggcuccuggcccgacggcgccgaccucaaccucaugcccaucuga

SEQ ID NO: 115829 - RNA, 1410 nt, Artificial Sequence
  derived and/or modified sequence opt2 from neuraminidase__InfluenzaA__AHC62533
augaaccccaaccagaagaucaucaccaucggcuccgucucccucaccaucuccaccaucugcuucuucaugcaggucgccauccucaucaccaccgucacccuccacuucaagcaguacgaguucaacuccccccccaacaaccaggucaugcucugcgagcccaccaucaucgagcgcaacaucaccgagauccucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggcaacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115830 - RNA, 1410 nt, Artificial Sequence; identical to SEQ ID NO: 115687
  derived and/or modified sequence opt2 from neuraminidase__InfluenzaA__AHC62545

SEQ ID NO: 115831 - RNA, 1410 nt, Artificial Sequence; identical to SEQ ID NO: 115532
  derived and/or modified sequence opt2 from neuraminidase__InfluenzaA__AHC62557

SEQ ID NO: 115832 - RNA, 1410 nt, Artificial Sequence; identical to SEQ ID NO: 115483
  derived and/or modified sequence opt2 from neuraminidase__InfluenzaA__AHC62569

SEQ ID NO: 115833 - RNA, 1410 nt, Artificial Sequence; identical to SEQ ID NO: 115532
  derived and/or modified sequence opt2 from neuraminidase__InfluenzaA__AHC62581

SEQ ID NO: 115834 - RNA, 1410 nt, Artificial Sequence
  derived and/or modified sequence opt2 from neuraminidase__InfluenzaA__AHC62593
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcaacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115835 - RNA, 1410 nt, Artificial Sequence; identical to SEQ ID NO: 115519
  derived and/or modified sequence opt2 from neuraminidase__InfluenzaA__AHC62605

SEQ ID NO: 115836 - RNA, 1410 nt, Artificial Sequence
  derived and/or modified sequence opt2 from neuraminidase__InfluenzaA__AHC62617
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcgcugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115837 - RNA, 1410 nt, Artificial Sequence; identical to SEQ ID NO: 115487
  derived and/or modified sequence opt2 from neuraminidase__InfluenzaA__AHC62629

SEQ ID NO: 115838 - RNA, 1410 nt, Artificial Sequence
  derived and/or modified sequence opt2 from neuraminidase__InfluenzaA__AHC62641
augaaccccaaccagaagaucaucaccaucggcuccgucucccucaccaucuccaccgucugcuucuucaugcaggucgccauccucaucaccaccgucacccuccacuucaagcaguacgaguucaacuccccccccaacaaccaggucaugcucugcgagcccaccaucaucgagcgcaacaucaccgagauccucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115839 - RNA, 1410 nt, Artificial Sequence; identical to SEQ ID NO: 115487
  derived and/or modified sequence opt2 from neuraminidase__InfluenzaA__AHC62653

SEQ ID NO: 115840 - RNA, 1410 nt, Artificial Sequence; identical to SEQ ID NO: 115487
  derived and/or modified sequence opt2 from neuraminidase__InfluenzaA__AHC62665

SEQ ID NO: 115841 - RNA, 1410 nt, Artificial Sequence
  derived and/or modified sequence opt2 from neuraminidase__InfluenzaA__AHC62677
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacaucuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115842 - RNA, 1398 nt, Artificial Sequence
  derived and/or modified sequence opt2 from neuraminidase__InfluenzaA__AHF20560
augaaccccaaccagaagauccucugcaccuccgccaccgccaucaucaucggcgccaucaccguccucaucggcaucgccaaccucggccucaacaucggccuccaccucaagcccggcugcaacugcucccacucccagcccgagaccaccaacaccucccagaccaucaucaacaacuacuacaacgagaccaacaccaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucgagcaguggaacuggcccgacggcgccaagaucgaguacuuccucuga

SEQ ID NO: 115843 - RNA, 1398 nt, Artificial Sequence; identical to SEQ ID NO: 114966
  derived and/or modified sequence opt2 from neuraminidase__InfluenzaA__AHF20570

SEQ ID NO: 115844 - RNA, 1413 nt, Artificial Sequence; identical to SEQ ID NO: 108144
  derived and/or modified sequence opt2 from neuraminidase__InfluenzaA__AHG96111

SEQ ID NO: 115845 - RNA, 1413 nt, Artificial Sequence; identical to SEQ ID NO: 108144
  derived and/or modified sequence opt2 from neuraminidase__InfluenzaA__AHG96123

SEQ ID NO: 115846 - RNA, 1413 nt, Artificial Sequence; identical to SEQ ID NO: 108144
  derived and/or modified sequence opt2 from neuraminidase__InfluenzaA__AHG96135

SEQ ID NO: 115847 - RNA, 1413 nt, Artificial Sequence; identical to SEQ ID NO: 108144
  derived and/or modified sequence opt2 from neuraminidase__InfluenzaA__AHG96147

SEQ ID NO: 115848 - RNA, 1413 nt, Artificial Sequence; identical to SEQ ID NO: 108144
  derived and/or modified sequence opt2 from neuraminidase__InfluenzaA__AHG96159

SEQ ID NO: 115849 - RNA, 1413 nt, Artificial Sequence; identical to SEQ ID NO: 108144
  derived and/or modified sequence opt2 from neuraminidase__InfluenzaA__AHG96171

SEQ ID NO: 115850 - RNA, 1413 nt, Artificial Sequence; identical to SEQ ID NO: 108144
  derived and/or modified sequence opt2 from neuraminidase__InfluenzaA__AHG96183

SEQ ID NO: 115851 - RNA, 1413 nt, Artificial Sequence; identical to SEQ ID NO: 108144
  derived and/or modified sequence opt2 from neuraminidase__InfluenzaA__AHG96195

SEQ ID NO: 115852 - RNA, 1413 nt, Artificial Sequence; identical to SEQ ID NO: 108144
  derived and/or modified sequence opt2 from neuraminidase__InfluenzaA__AHG96207

SEQ ID NO: 115853 - RNA, 1413 nt, Artificial Sequence; identical to SEQ ID NO: 108144
  derived and/or modified sequence opt2 from neuraminidase__InfluenzaA__AHG96219

SEQ ID NO: 115854 - RNA, 1413 nt, Artificial Sequence; identical to SEQ ID NO: 108144
  derived and/or modified sequence opt2 from neuraminidase__InfluenzaA__AHG96231

SEQ ID NO: 115855 - RNA, 1413 nt, Artificial Sequence; identical to SEQ ID NO: 108144
  derived and/or modified sequence opt2 from neuraminidase__InfluenzaA__AHG96243

SEQ ID NO: 115856 - RNA, 1413 nt, Artificial Sequence; identical to SEQ ID NO: 108144
  derived and/or modified sequence opt2 from neuraminidase__InfluenzaA__AHG96255

SEQ ID NO: 115857 - RNA, 1413 nt, Artificial Sequence; identical to SEQ ID NO: 108144
  derived and/or modified sequence opt2 from neuraminidase__InfluenzaA__AHG96267

SEQ ID NO: 115858 - RNA, 1413 nt, Artificial Sequence; identical to SEQ ID NO: 108144
  derived and/or modified sequence opt2 from neuraminidase__InfluenzaA__AHG96279

SEQ ID NO: 115859 - RNA, 1413 nt, Artificial Sequence; identical to SEQ ID NO: 108144
  derived and/or modified sequence opt2 from neuraminidase__InfluenzaA__AHG96291

SEQ ID NO: 115860 - RNA, 1413 nt, Artificial Sequence; identical to SEQ ID NO: 108144
  derived and/or modified sequence opt2 from neuraminidase__InfluenzaA__AHG96303

SEQ ID NO: 115861 - RNA, 1410 nt, Artificial Sequence; identical to SEQ ID NO: 107968
  derived and/or modified sequence opt2 from neuraminidase__InfluenzaA__AHG96362

SEQ ID NO: 115862 - RNA, 1410 nt, Artificial Sequence; identical to SEQ ID NO: 107968
  derived and/or modified sequence opt2 from neuraminidase__InfluenzaA__AHG96374

SEQ ID NO: 115863 - RNA, 1410 nt, Artificial Sequence; identical to SEQ ID NO: 107968
  derived and/or modified sequence opt2 from neuraminidase__InfluenzaA__AHG96386

SEQ ID NO: 115864 - RNA, 1413 nt, Artificial Sequence; identical to SEQ ID NO: 108144
  derived and/or modified sequence opt2 from neuraminidase__InfluenzaA__AHG96398

SEQ ID NO: 115865 - RNA, 1410 nt, Artificial Sequence; identical to SEQ ID NO: 107968
  derived and/or modified sequence opt2 from neuraminidase__InfluenzaA__AHG96410

SEQ ID NO: 115866 - RNA, 1410 nt, Artificial Sequence; identical to SEQ ID NO: 107968
  derived and/or modified sequence opt2 from neuraminidase__InfluenzaA__AHG96422

SEQ ID NO: 115867 - RNA, 1410 nt, Artificial Sequence; identical to SEQ ID NO: 107968
  derived and/or modified sequence opt2 from neuraminidase__InfluenzaA__AHG96434

SEQ ID NO: 115868 - RNA, 1410 nt, Artificial Sequence; identical to SEQ ID NO: 107968
  derived and/or modified sequence opt2 from neuraminidase__InfluenzaA__AHG96446

SEQ ID NO: 115869 - RNA, 1410 nt, Artificial Sequence; identical to SEQ ID NO: 107968
  derived and/or modified sequence opt2 from neuraminidase__InfluenzaA__AHG96458

SEQ ID NO: 115870 - RNA, 1410 nt, Artificial Sequence; identical to SEQ ID NO: 107968
  derived and/or modified sequence opt2 from neuraminidase__InfluenzaA__AHG96470

SEQ ID NO: 115871 - RNA, 1410 nt, Artificial Sequence; identical to SEQ ID NO: 107968
  derived and/or modified sequence opt2 from neuraminidase__InfluenzaA__AHG96482

SEQ ID NO: 115872 - RNA, 1410 nt, Artificial Sequence; identical to SEQ ID NO: 107968
  derived and/or modified sequence opt2 from neuraminidase__InfluenzaA__AHG96494

SEQ ID NO: 115873 - RNA, 1410 nt, Artificial Sequence; identical to SEQ ID NO: 107968
  derived and/or modified sequence opt2 from neuraminidase__InfluenzaA__AHG96506

SEQ ID NO: 115874 - RNA, 1413 nt, Artificial Sequence; identical to SEQ ID NO: 108144
  derived and/or modified sequence opt2 from neuraminidase__InfluenzaA__AHG96518

SEQ ID NO: 115875 - RNA, 1413 nt, Artificial Sequence; identical to SEQ ID NO: 108144
  derived and/or modified sequence opt2 from neuraminidase__InfluenzaA__AHG96530

SEQ ID NO: 115876 - RNA, 1413 nt, Artificial Sequence; identical to SEQ ID NO: 108144
  derived and/or modified sequence opt2 from neuraminidase__InfluenzaA__AHG96542

SEQ ID NO: 115877 - RNA, 1413 nt, Artificial Sequence; identical to SEQ ID NO: 108144
  derived and/or modified sequence opt2 from neuraminidase__InfluenzaA__AHG96554

SEQ ID NO: 115878 - RNA, 1413 nt, Artificial Sequence; identical to SEQ ID NO: 108144
  derived and/or modified sequence opt2 from neuraminidase__InfluenzaA__AHG96566

SEQ ID NO: 115879 - RNA, 1413 nt, Artificial Sequence; identical to SEQ ID NO: 108144
  derived and/or modified sequence opt2 from neuraminidase__InfluenzaA__AHG96578

SEQ ID NO: 115880 - RNA, 1413 nt, Artificial Sequence; identical to SEQ ID NO: 108144
  derived and/or modified sequence opt2 from neuraminidase__InfluenzaA__AHG96590

SEQ ID NO: 115881 - RNA, 1413 nt, Artificial Sequence; identical to SEQ ID NO: 108144
  derived and/or modified sequence opt2 from neuraminidase__InfluenzaA__AHG96602

SEQ ID NO: 115882 - RNA, 1413 nt, Artificial Sequence; identical to SEQ ID NO: 108144
  derived and/or modified sequence opt2 from neuraminidase__InfluenzaA__AHG96614

SEQ ID NO: 115883 - RNA, 1413 nt, Artificial Sequence; identical to SEQ ID NO: 108144
  derived and/or modified sequence opt2 from neuraminidase__InfluenzaA__AHG96626

SEQ ID NO: 115884 - RNA, 1413 nt, Artificial Sequence; identical to SEQ ID NO: 108144
  derived and/or modified sequence opt2 from neuraminidase__InfluenzaA__AHG96638

SEQ ID NO: 115885 - RNA, 1413 nt, Artificial Sequence; identical to SEQ ID NO: 108144
  derived and/or modified sequence opt2 from neuraminidase__InfluenzaA__AHG96650

SEQ ID NO: 115886 - RNA, 1413 nt, Artificial Sequence; identical to SEQ ID NO: 108144
  derived and/or modified sequence opt2 from neuraminidase__InfluenzaA__AHG96662

SEQ ID NO: 115887 - RNA, 1413 nt, Artificial Sequence; identical to SEQ ID NO: 108144
  derived and/or modified sequence opt2 from neuraminidase__InfluenzaA__AHG96674

SEQ ID NO: 115888 - RNA, 1413 nt, Artificial Sequence; identical to SEQ ID NO: 108144
  derived and/or modified sequence opt2 from neuraminidase__InfluenzaA__AHG96686

SEQ ID NO: 115889 - RNA, 1410 nt, Artificial Sequence; identical to SEQ ID NO: 107968
  derived and/or modified sequence opt2 from neuraminidase__InfluenzaA__AHG96698

SEQ ID NO: 115890 - RNA, 1410 nt, Artificial Sequence; identical to SEQ ID NO: 107968
  derived and/or modified sequence opt2 from neuraminidase__InfluenzaA__AHG96710

SEQ ID NO: 115891 - RNA, 1410 nt, Artificial Sequence; identical to SEQ ID NO: 107968
  derived and/or modified sequence opt2 from neuraminidase__InfluenzaA__AHG96722

SEQ ID NO: 115892 - RNA, 1410 nt, Artificial Sequence; identical to SEQ ID NO: 107968
  derived and/or modified sequence opt2 from neuraminidase__InfluenzaA__AHG96734

SEQ ID NO: 115893 - RNA, 1410 nt, Artificial Sequence; identical to SEQ ID NO: 107968
  derived and/or modified sequence opt2 from neuraminidase__InfluenzaA__AHG96746

SEQ ID NO: 115894 - RNA, 1410 nt, Artificial Sequence; identical to SEQ ID NO: 107968
  derived and/or modified sequence opt2 from neuraminidase__InfluenzaA__AHG96758

SEQ ID NO: 115895 - RNA, 1410 nt, Artificial Sequence; identical to SEQ ID NO: 107968
  derived and/or modified sequence opt2 from neuraminidase__InfluenzaA__AHG96770

SEQ ID NO: 115896 - RNA, 1410 nt, Artificial Sequence; identical to SEQ ID NO: 107968
  derived and/or modified sequence opt2 from neuraminidase__InfluenzaA__AHG96782

SEQ ID NO: 115897 - RNA, 1410 nt, Artificial Sequence; identical to SEQ ID NO: 107968
  derived and/or modified sequence opt2 from neuraminidase__InfluenzaA__AHG96794

SEQ ID NO: 115898 - RNA, 1410 nt, Artificial Sequence; identical to SEQ ID NO: 107968
  derived and/or modified sequence opt2 from neuraminidase__InfluenzaA__AHG96806

SEQ ID NO: 115899 - RNA, 1410 nt, Artificial Sequence; identical to SEQ ID NO: 107968
  derived and/or modified sequence opt2 from neuraminidase__InfluenzaA__AHG96818

SEQ ID NO: 115900 - RNA, 1410 nt, Artificial Sequence; identical to SEQ ID NO: 107968
  derived and/or modified sequence opt2 from neuraminidase__InfluenzaA__AHG96830

SEQ ID NO: 115901 - RNA, 1410 nt, Artificial Sequence; identical to SEQ ID NO: 107968
  derived and/or modified sequence opt2 from neuraminidase__InfluenzaA__AHG96842

SEQ ID NO: 115902 - RNA, 1410 nt, Artificial Sequence; identical to SEQ ID NO: 107968
  derived and/or modified sequence opt2 from neuraminidase__InfluenzaA__AHG96854

SEQ ID NO: 115903 - RNA, 1410 nt, Artificial Sequence; identical to SEQ ID NO: 107968
  derived and/or modified sequence opt2 from neuraminidase__InfluenzaA__AHG96866

SEQ ID NO: 115904 - RNA, 1410 nt, Artificial Sequence; identical to SEQ ID NO: 107968
  derived and/or modified sequence opt2 from neuraminidase__InfluenzaA__AHG96878

SEQ ID NO: 115905 - RNA, 1410 nt, Artificial Sequence; identical to SEQ ID NO: 107968
  derived and/or modified sequence opt2 from neuraminidase__InfluenzaA__AHG96890

SEQ ID NO: 115906 - RNA, 1410 nt, Artificial Sequence; identical to SEQ ID NO: 107968
  derived and/or modified sequence opt2 from neuraminidase__InfluenzaA__AHG96902

SEQ ID NO: 115907 - RNA, 1410 nt, Artificial Sequence; identical to SEQ ID NO: 107968
  derived and/or modified sequence opt2 from neuraminidase__InfluenzaA__AHG96914

SEQ ID NO: 115908 - RNA, 1410 nt, Artificial Sequence; identical to SEQ ID NO: 107968
  derived and/or modified sequence opt2 from neuraminidase__InfluenzaA__AHG96926

SEQ ID NO: 115909 - RNA, 1410 nt, Artificial Sequence; identical to SEQ ID NO: 107968
  derived and/or modified sequence opt2 from neuraminidase__InfluenzaA__AHG96938

SEQ ID NO: 115910 - RNA, 1410 nt, Artificial Sequence; identical to SEQ ID NO: 107968
  derived and/or modified sequence opt2 from neuraminidase__InfluenzaA__AHG96950

SEQ ID NO: 115911 - RNA, 1410 nt, Artificial Sequence; identical to SEQ ID NO: 107968
  derived and/or modified sequence opt2 from neuraminidase__InfluenzaA__AHG96962

SEQ ID NO: 115912 - RNA, 1410 nt, Artificial Sequence; identical to SEQ ID NO: 107968
  derived and/or modified sequence opt2 from neuraminidase__InfluenzaA__AHG96974

SEQ ID NO: 115913 - RNA, 1410 nt, Artificial Sequence; identical to SEQ ID NO: 107968
  derived and/or modified sequence opt2 from neuraminidase__InfluenzaA__AHG96986

SEQ ID NO: 115914 - RNA, 1410 nt, Artificial Sequence; identical to SEQ ID NO: 107968
  derived and/or modified sequence opt2 from neuraminidase__InfluenzaA__AHG96998

SEQ ID NO: 115915 - RNA, 1410 nt, Artificial Sequence; identical to SEQ ID NO: 107968
  derived and/or modified sequence opt2 from neuraminidase__InfluenzaA__AHG97010

SEQ ID NO: 115916 - RNA, 1410 nt, Artificial Sequence; identical to SEQ ID NO: 107968
  derived and/or modified sequence opt2 from neuraminidase__InfluenzaA__AHG97022

SEQ ID NO: 115917 - RNA, 1410 nt, Artificial Sequence; identical to SEQ ID NO: 107968
  derived and/or modified sequence opt2 from neuraminidase__InfluenzaA__AHG97034

SEQ ID NO: 115918 - RNA, 1410 nt, Artificial Sequence; identical to SEQ ID NO: 107968
  derived and/or modified sequence opt2 from neuraminidase__InfluenzaA__AHG97046

SEQ ID NO: 115919 - RNA, 1410 nt, Artificial Sequence
  derived and/or modified sequence opt2 from neuraminidase__InfluenzaA__AHH00872
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucaucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucaucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgaccucaaccucaugcccaucuga

SEQ ID NO: 115920 - RNA, 1416 nt, Artificial Sequence
  derived and/or modified sequence opt2 from neuraminidase__InfluenzaA__AHI43497
augaaccccaaccagaagcucuucgcccucuccggcgucgccaucgcccucuccauccucaaccuccucaucggcaucuccaacgucggccucaacaucucccuccaccucaagggcaagggccccaagcaggaggagaaccucaccugcaccaccaucaaccagaacaacaccaccgucgucgagaacaccuacgucaacaacaccaccaucaucaccaaggagaccgacuggaacacccccuccuaccuccuccucaacaagucccucugcaacgucgagggcugggucgucaucgccaaggacaacgccauccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccggcuucaugugcgucggcugguccuccaccaccugccacgacggcaucggccgcaugaccaucugcauccagggcaacaacgacaacgccaccgccaccgucuacuacaacggccgccucaccaccaccaucaagaccugggcccgcaacauccuccgcacccaggaguccgagugcgucugccacaacggcaccugcgccgucgucaugaccgacggcuccgccuccucccaggccuacaccaaggucauguacuuccacaagggccucgucaucaaggaggaggcccuccgcggcuccgcccgccacaucgaggagugcuccugcuacggccacucccagcgcgucaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccagggcgucaagggcuucggcuuccucaacggcgacaacaccuggcucggccgcaccaucuccccccgcucccgcuccggcuucgagaugcucaagauccccaacgccggcaccgaccccaacucccgcaucgccgagcgccaggagaucgucgacaacaacaacugguccggcuacuccggcuccuucaucgacuacuggaacaacaacuccgagugcuacaaccccugcuucuacgucgagcucauccgcggccgccccgaggaggccaaguacgucugguggaccuccaacucccucaucgcccucugcggcucccccuuccccgucggcuccggcuccuuccccgacggcgcccagauccaguacuucuccuga

SEQ ID NO: 115921 - RNA, 1410 nt, Artificial Sequence
  derived and/or modified sequence opt2 from neuraminidase__InfluenzaA__AHJ57439
augaaccccaaccagaagaucaucaccaucggcuccgucucccucaucaucuccaccaucugcuucuucaugcaggucgccauccuccucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115922 - RNA, 1410 nt, Artificial Sequence
  derived and/or modified sequence opt2 from neuraminidase__InfluenzaA__AHJ57440
augaaccccaaccagaagaucaucaccaucggcuccgucucccucaucaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115923 - RNA, 1410 nt, Artificial Sequence
  derived and/or modified sequence opt2 from neuraminidase__InfluenzaA__AHJ57441
augaaccccaaccagaagaucaucaccaucggcuccgucucccucaucaucuccaccaucugcuucuucaugcagaucgccauccucaucaccaccgucacccuccacuucaagcaguacgaguucaacuccccccccaacaaccaggucaugcucugcgagcccaccaucaucgagcgcaacaagaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 115924 - RNA, 1413 nt, Artificial Sequence
  derived and/or modified sequence opt2 from neuraminidase__InfluenzaA__AHJ57654
augaaccccaaccagaagaucaccugcaucuccgccaccggcaugacccucuccgucgucucccuccucaucggcaucgccaaccucggccucaacaucggccuccacuacaaggucuccgacuccaccaacaucaacauccccaacaugaacgagaccucccccaccaccaccaucaucaacaaccacccccagaacaacuucaccaacaucaccaacaucaucaugaacaagaacgaggagggcaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagguccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagauccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115925 - RNA, 1410 nt, Artificial Sequence
  derived and/or modified sequence opt2 from neuraminidase__InfluenzaA__AHJ57666
augaaccccaaccagaagaucaucaccaucggcuccgucucccucaccaucgccaccgucuccuuccucaugcagaucgccauccucaccaccaccgucacccuccacuucaagcacaacgagugcaacaugccccccaagaaccaggucauguccugcgagcccaucaucaucgagcgcaacaucaccgagaucgucuaccucaacaacaccaccgucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacaucugcaucaccggcgacgaccgcaacgccaccgccuccuucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucgacaucaacauggccgacuacuccaucgacuccaacuacgucugcuccggccucgucggcgacaccccccgcaacgacgacaacuccuccuccuccaacugccgcgaccccaacaacgagcgcggcaaccccggcgucaagggcugggccuucgacgacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucaucaagggccgcccccaggagccccgcgucugguggaccuccaacuccaucgucgucuucugcggcaccuccggcaccuacggcaccggcuccuggcccgacggcgccaacaucaacuucaugcccaucuga

SEQ ID NO: 115926 - RNA, 1413 nt, Artificial Sequence
  derived and/or modified sequence opt2 from neuraminidase__InfluenzaA__AHJ57677
augaaccccaaccagaagaucaccugcaucuccgccaccggcaugacccucuccgucgucuccaugcucaucggcaucgccaaccucggccucaacaucggccuccacuacaaggucuccgacuccaccaacaucaacauccccaacaugaacgagaccucccccaccaccaccgucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccagcacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaaggucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaugaucgucaacaaccagaacugguccggcuacuccggcgccuucaucgacuacugggccaagaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115927 - RNA, 1413 nt, Artificial Sequence
  derived and/or modified sequence opt2 from neuraminidase__InfluenzaA__AHJ57689
augaaccccaaccagaagaucaccugcaucuccgccaccggcaugacccucuccgucgucuccaugcucaucggcaucgccaaccucggccucaacaucggccuccacuacaaggucuccgacuccaccaacaucaacauccccaagaugaacgagaccucccccaccaccaccaucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccagcacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115928 - RNA, 1413 nt, Artificial Sequence
  derived and/or modified sequence opt2 from neuraminidase__InfluenzaA__AHJ57700
augaaccccaaccagaagaucaccugcaucuccgccaccggcaugacccucuccgucgucucccuccucaucggcaucgccaaccucggccucaacaucggccuccacuacaaggucuccgacuccaccaacaucaacauccccaacaugaacgagaccucccccaccaccaccaucaucaacaaccacccccagaacaacuucaccaacaucaccaacaucaucaugaacaagaacgaggagggcaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagguccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115929 - RNA, 1410 nt, Artificial Sequence
  derived and/or modified sequence opt2 from neuraminidase__InfluenzaA__AHJ57710
augaaccccaaccagaagaucaucaccaucggcuccgucucccucaccaucgccaccgucuccuuccucaugcagaucgccauccucaccaccaccgucacccuccacuucaagcacaacgagugcaacaugccccccaagaaccaggucauguccugcgagcccaucaucaucgagcgcaacaucaccgagaucgucuaccucaacaacaccaccgucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacaucugcaucaccggcgacgaccgcaacgccaccgccuccuucaucuacgacggcaugcucgucgacuccaucuccuccugguccaagaacauccuccgcacccaggaguccgagugcgucugcaucaacggcaccugcgccgucgucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucaacaucaacauggccgacuacuccaucgacuccaacuacgucugcuccggccucgucggcgacaccccccgcaacgacgacaacuccuccuccuccaacugccgcgaccccaacaacgagcgcggcaaccccggcgucaagggcugggccuucgacgacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagccccgcgucugguggaccuccaacuccaucgucgucuucugcggcaccuccggcaccuacggcaccggcuccuggcccgacggcgccaacaucaacuucaugcccaucuga

SEQ ID NO: 115930 - RNA, 1410 nt, Artificial Sequence
  derived and/or modified sequence opt2 from neuraminidase__InfluenzaA__AHJ57734
augaaccccaaccagaagaucaucaccaucggcuccgucucccucaccaucgccaccgucuccuuccucaugcagaucgccauccucaccaccaccgucacccuccacuucaagcacaacgagugcaacaugccccccaagaaccaggucauguccugcgagcccaucaucaucgagcgcaacaucaccgagaucgucuaccucaacaacaccaccgucgagaaggagaucugccccaaggucgccgaguaccgcaacugguccaagccccagugcaagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacaucugcaucaccggcgacgaccgcaacgccaccgccuccuucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucaacaucaacauggccgacuacuccaucgacuccaacuacgucugcuccggccucgucggcgacaccccccgcaacgacgacaacuccuccuccuccaacugccgcgaccccaacaacgagcgcggcaaccccggcgucaagggcugggccuucgacgacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagccccgcgucugguggaccuccaacuccaucgucgucuucugcggcaccuccggcaccuacggcaccggcuccuggcccgacggcgccaacaucaacuucaugcccaucuga

SEQ ID NO: 115931 - RNA, 1380 nt, Artificial Sequence
  derived and/or modified sequence opt2 from neuraminidase__InfluenzaA__AHJ57746
augaaccccaaccagaagaucaucaccaucggcuccgucuccaucaccaucgccgccgucugcuuccucaugcagaucgccauccucgccaccaccgucacccuccacuucaagcagaacgagugcaacauccccuccaagaaccacgucauccccugcgagcccaucaucaucgagcgcaacaucaccgaggucgagauccgccccaaggucgccgaguaccgcgacugguccaagccccagugccagaucaccggcuucgcccccuucuccaaggacaacuccauccgccucuccgccggcggcaacaucugggucacccgcgagcccuacgucuccugcggccccgacaagugcuaccaguucgcccucggccagggcaccacccucggcaacggccacuccaacggcaccauccacgacaagaucccccaccgcacccuccucaugaacgagcucggcguccccuuccaccucggcaccaagcaggucugcaucgccugguccuccuccuccugccacgacggccgcgccuggcuccacgucugcgucaccggcgacgaccgcaacgccaccgccuccuucaucuacgacggcaugcucgucgacuccaucgccuccuggucccagaacauccuccgcacccaggaguccgagugcgucugcaucaacggcaccugcaccgucgucaugaccgacggcuccgccuccggcgucgccgacacccgcauccucuucauccgcgagggcaagaucguccacaucuccccccucuccggcuccgcccagcacaucgaggagugcuccugcuacccccgccacuccgacguccgcugcgucugccgcgacaacuggaagggcuccaaccgccccgucgucgacaucaacaugaccgacuacuccaucgacuccuccuacgucugcuccggccucgucggcgacaccccccgcaacgacgacuccuccuccuccuccaacugccgcgaccccaacaacgagcgcggcaaccccggcgucaagggcugggccuucgacgacggcgacgacgucuggaugggccgcaccaucucccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 115932 - RNA, 1410 nt, Artificial Sequence
  derived and/or modified sequence opt2 from neuraminidase__InfluenzaA__AHJ57758
augaaccccaaccagaagaucaucaccgucggcuccgucucccucgccaucgccaccaucugccuccucaugcagaucgccauccucgccaccaccgucacccuccacuucaagcagaacgagugcaacauccccuccaagaaccaggucaugcccugcgagcccaucaucaucgagcgcaacaucaccgaggucgucuaccucaacaacaccaucaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcucccccuccaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacgucugcaucaccggcgacgaccgcaacgccaccgccuccuucaucuacaacggcaugcucgucgacuccaucuccuccuggucccgcaacauccuccgcacccaggaguccgagugcgucugcaucaacggcaccugcaccgucaucaugaccgacggcuccgccuccggcgucgccgacacccgcauccucuucauccgcgagggcaacaucguccacgucuccccccucuccggcuccgcccagcacaucgaggagugcuccugcuacccccgcuaccccgacguccgcugcgucugccgcgacaacuggaagggcuccaaccgccccgucgucgacaucaacauggccgacuacuccaucgacucccacuacgucugcuccggccucgucggcgacaccccccgcaacgacgacuccuccuccuccuccaacugcaaggaccccaacaacgagcgcggcaaccccggcgucaagggcugggccuucgacgacggcaacgacgucuggaugggccgcaccaucucccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 115933 - RNA, 1401 nt, Artificial Sequence
  derived and/or modified sequence opt2 from neuraminidase__InfluenzaA__AHJ57770
augaaccccaaccagaagaucaucgccaucggcuccgucucccucaccaucgccaucaucugcuuccucaugcagaucgccauccucaccaccaccaugacccuccacuucaagcagaacgagugcuccaaccccuccaacaaccaggucguccccugcgagcccaucaucaucgagcgcaacaccguccaccucaacuccaccaccaucgagaaggagaucugccccaaggucgucgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccgucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacgacucccgcuccggcuacgagaccuuccgcgucgucaacggcuggaccaccgccaacuccaagucccagaucaaccgccaggucaucgucgacuccgagaacugguccggcuacuccggcaucuucuccgucgagggcaagaacugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuuccuccccaucuga

SEQ ID NO: 115934 - RNA, 1410 nt, Artificial Sequence
  derived and/or modified sequence opt2 from neuraminidase__InfluenzaA__AHJ57782
augaaccccaaccagaagaucaucaucaucggcuccgucucccucaccaucgccaccgucugcuuccucaugcagaucgccauccucgccaccaccgucacccuccacuucaagcagaacgagugcaacauccccuccaagaaccaggucguccccugcgagcccaucaucaucgagcgcaacaucaccgaggucgucuaccucaacaacaccaccaucgagaaggagaucugccccgccgucgucgaguaccgcaacugguccaagccccagugccagaucaagggcuucgcccccuucuccaaggacaacuccauccgccucuccgccggcggcgacaugugggucacccgcgagcccuacgucuccugcucccccuccaagugcuaccaguucgcccucggccagggcaccacccucgacaacaaccacuccaacggcaccauccacgaccgcaucccccaccgcacccuccucaugaacgagcucggcguccccuuccaccucggcaccaagcaggucugcaucgccugguccuccuccuccugccacgacggcaaggccuggcuccacgucugcgucaccggcgacgaccgcaacgccaccgccuccuucaucuacgacggcaugcucgucgacuccaucggcuccuggucccagaacauccuccgcacccaggaguccgagugcgucugcaucaacggcaccugcaccgucgucaugaccgacggcuccgccuccggcaucgccgacacccgcauccucuucguccgcgagggcaagaucguccacaucuccccccucuccggcuccgcccagcacaucgaggagugcuccugcuacccccgcuaccccgacguccgcugcgucugccgcgacaacuggaagggcuccaaccgccccaucgucgacaucaacauggccgacuacuccaucggcuccuccuacgucugcuccggccucgucggcgacaccccccgcaacgacgaccgcuucuccuccuccaacugccgcgaccccaacuccgagcgcggcaaccccggcgucaagggcugggccuucgacgacggcgacgacgucuggaugggccgcaccaucucccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 115935 - RNA, 1410 nt, Artificial Sequence
  derived and/or modified sequence opt2 from neuraminidase__InfluenzaA__AHJ57794
augaaccccaaccagaagaucaucaccgucggcuccgucucccucgccaucgccaccaucugcuuccucaugcagaucgccauccucgccaccaccgucacccuccacuucaagcagaacgagugcaacauccccuccaagaaccaggucaugcccugcgagcccaucaucaucgagcgcaacaucaccgaggucgucuaccucaacaacaccaucaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcucccccuccaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacgucugcaucaccggcgacgaccgcaacgccaccgccuccuucaucuacaacggcaugcucgucgacuccaucuccuccuggucccgcaacauccuccgcacccaggaguccgagugcgucugcaucaacggcaccugcaccgucaucaugaccgacggcuccgccuccggcgucgccgacacccgcauccucuucauccgcgagggcaacaucguccacgucuccccccucuccggcuccgcccagcacaucgaggagugcuccugcuacccccgcuaccccgacguccgcugcgucugccgcgacaacuggaagggcuccaaccgccccgucgucgacaucaacauggccgacuacuccaucgacucccacuacgucugcuccggccucgucggcgacaccccccgcaacgacgacuccuccuccuccuccaacugcaaggaccccaacaacgagcgcggcaaccccggcgucaagggcugggccuccgacgacggccacgacgucuggaugggccgcaccaucggccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 115936 - RNA, 1413 nt, Artificial Sequence
  derived and/or modified sequence opt2 from neuraminidase__InfluenzaA__AHJ57806
augaaccccaaccagaagaucaccugcaucuccgccaccggcaugacccucuccgucgucucccuccucaccggcaucgccaaccucggccucaacaucggccuccacuacaaggucuccgacuccaccaacaucuccauccccaacaugaacgaggccucccccaccaccaccaucaucaacaaccacccccagaacaacuucaccaacaucaccaacaucaucaugaacaagaacgaggagggcaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcaagaacuccuggcucggccgcaccaucuccaaggacucccgcuccggcuacgagaugcucaagguccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115937 - RNA, 1380 nt, Artificial Sequence
  derived and/or modified sequence opt2 from neuraminidase__InfluenzaA__AHJ57818
augaaccccaaccagaagaucaccugcaucuccgccaccggcgucacccucuccgucgucucccuccucaucggcaucgccaaccucggccucaacaucggccuccacuacaaggucuccgacucccccaccaucaacauccccaacaugaacgagaccaaccccaucaccaccaacaucaccaacaucaucgucaacaagaacgaggagggcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggccggcaacauccuccgcacccaggaguccgagugcgucugccacaagggcaucugccccgucgucaugaccgacggccccgccaacaacaaggccgccaccaagaucaucuacuucaaggagggcaagauccagaagaucgaggagcuccagggcaacgcccagcacaucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccgacggcaacugcgacgcccccaucaccggcggcucccccgaccccggcgucaagggcuucgccuuccucgagggcgagaacuccuggcucggccgcaccaucuccaaggacucccgcuccggcuacgagaugcucaagguccccaacgccgagaccgacacccaguccggcgccaucucccaccagaugaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115938 - RNA, 1410 nt, Artificial Sequence
  derived and/or modified sequence opt2 from neuraminidase__InfluenzaA__AHJ57830
augaaccccaaccagaagaucaucaccaucggcuccgucucccucaccaucgccaccgucuccuuccucaugcagaucgccauccucaccaccaccgucacccuccacuucaagcacaacgagugcaacaugccccccaagaaccaggucauguccugcgagcccaucaucaucgagcgcaacaucaccgagaucgucuaccucaacaacaccaccaucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacaucugcaucaccggcgacgaccgcaacgccaccgccuccuucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucgacaucaacauggccgacuacuccaucgacuccaacuacgucugcuccggccucgucggcgacaccccccgcaacgacgacaacuccuccuccuccaacugccgcgaccccaacaacgagcgcggcaaccccggcgucaagggcugggccuucgacgacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagccccgcgucugguggaccuccaacuccaucgucgucuucugcggcaccuccggcaccuacggcaccggcuccuggcccgacggcgccaacaucaacuucaugcccaucuga

SEQ ID NO: 115939 - RNA, 1413 nt, Artificial Sequence
  derived and/or modified sequence opt2 from neuraminidase__InfluenzaA__AHJ57842
augaaccccaaccagaagaucaccugcaucuccgccaccggcaugacccucuccgucgucuccaugcucaucggcaucgccaaccucggccucaacaucggccuccacuacaaggucuccgacuccaccaacaucaacauccccaagaugaacgagaccaaccccaccaccaccaucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccaccauccgcggccagcacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcuccuccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115940 - RNA, 1413 nt, Artificial Sequence
  derived and/or modified sequence opt2 from neuraminidase__InfluenzaA__AHJ57853
augaaccccaaccagaagaucaccugcaucuccgccaccggcaugacccucuccgucgucucccuccucaucggcaucgccaaccucggccucaacgucggccuccacuacaaggucaacgaccccaccaacaucaacauccccaacaugaacgagaccucccccaccaccaccaucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccagcacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaugaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115941 - RNA, 1413 nt, Artificial Sequence
  derived and/or modified sequence opt2 from neuraminidase__InfluenzaA__AHJ57865
augaaccccaaccagaagaucaccugcaucuccgccaccggcaugacccucuccgucgucuccaugcucaucggcaucgccaaccucggccucaacaucggccuccacuacaaggucuccgacuccaccaacaucaacauccccaagaugaacgagaccaaccccaccaccaccaucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaugaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115942 - RNA, 1413 nt, Artificial Sequence
  derived and/or modified sequence opt2 from neuraminidase__InfluenzaA__AHJ57876
augaaccccaaccagaagaucaccugcaucuccgccaccggcaugacccucuccgucgucucccuccucaucggcaucgccaaccucggccucaacaucggccuccacuacaaggucuccgacuccaccaacaucaacauccccaacaugaacgagaccucccccaccaccaccaucaucaacaaccacccccagaacaacuucaccaacaucaccaacaucaucaugaacaagaacgaggagggcaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaagucccgcauguccaucugcaucuccggccccaacaacaacgccuccgccgucgucugguacggcggccgccccaucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagguccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115943 - RNA, 1413 nt, Artificial Sequence
  derived and/or modified sequence opt2 from neuraminidase__InfluenzaA__AHJ57888
augaaccccaaccagaagaucaccugcaucuccgccaccggcaugacccucuccgucgucuccaugcucaucggcaucgccaaccucggccucaacaucggccuccacuacaaggucuccgacuccaccaacaucaacauccccaacaugaacgagaccucccccaccaccaccaucaccaacaaccacccccagaacaacuucaccaacaucaccaacaucaucgucuccaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccagcacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaugaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115944 - RNA, 1413 nt, Artificial Sequence
  derived and/or modified sequence opt2 from neuraminidase__InfluenzaA__AHJ57900
augaaccccaaccagaagaucaccugcaucuccgccaccggcaugacccucuccgucgucucccuccucaucggcaucgccaaccucggccucaacaucggccuccacuacaaggucuccgacuccaccaacaucaacauccccaacaugaacgagaccucccccaccgccaccaucaucaacaaccacccccagaacaacuucaccaacaucaccaacaucaucgucaacaagaacgaggaggagaacuucuucaaccucgccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccagcacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggaccucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaugaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115945 - RNA, 1413 nt, Artificial Sequence
  derived and/or modified sequence opt2 from neuraminidase__InfluenzaA__AHJ57911
augaaccccaaccagaagaucaccugcaucuccgccaccggcgucacccucuccgucgucucccuccucaucggcaucgccaaccucggccucaacaucggccuccacuacaaggucuccgacuccuccaacaucaacauccccaacaugaacgagaccaaccccaccaccaccaucaucaacaaccacacccagaacaacuucaagaacaucaccaacaucaucgucaacaagaacgaggagggcaucuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguaccgcggccgccccgucaccgagauccccuccugggccggcaacauccuccgcacccaggaguccgagugcgucugccacaagggcaucugccccgucgucaugaccgacggccccgccaacaaccgcgccgccaccaagaucaucuacuucaaggagggcaagauccagaagaucgaggagcucaagggcaacgcccagcacaucgaggagugcuccugcuacggcgccgccggcaugaucaagugcaucugccgcgacaacuggcgcggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcuccaccuccuaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115946 - RNA, 1410 nt, Artificial Sequence
  derived and/or modified sequence opt2 from neuraminidase__InfluenzaA__AHJ57923
augaaccccaaccagaagaucaucaccgucggcuccgucucccucgccaucgccaccaucugcuuccucaugcagaucgccauccucgccaccaccgucacccuccacuucaagcagaacgagugcaacauccccuccaagaaccaggucaugcccugcgagcccaucaucaucgagcgcaacaucaccgaggucgucuaccucaacaacaccaucaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcucccccuccaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacgucugcaucaccggcgacgaccgcaacgccaccgccuccuucaucuacaacggcaugcucgucgacuccaucuccuccuggucccgcaacauccuccgcacccaggaguccgagugcgucugcaucaacggcaccugcaccgucaucaugaccgacggcuccgccuccggcgucgccgacacccgcauccucuucauccgcgagggcaagaucguccacgucuccccccucuccggcuccgcccagcacaucgaggagugcuccugcuacccccgcuaccccgacguccgcugcgucugccgcgacaacuggaagggcuccaaccgccccgucgucgacaucaacauggccgacuacuccaucgacucccacuacgucugcuccggccucgucggcgacaccccccgcaacgacgacuccuccuccuccuccaacugcaaggaccccaacaacgagcgcggcaaccccggcgucaagggcugggccuucgacgacggcaacgacgucuggaugggccgcaccaucucccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 115947 - RNA, 1380 nt, Artificial Sequence
  derived and/or modified sequence opt2 from neuraminidase__InfluenzaA__AHJ57935
augaaccccaaccagaagaucaccugcaucuccgccaccggcgucacccucuccgucgucucccuccucaucggcaucgccaaccucggccucaacaucggccuccacuacaaggucuccgacucccccaccaucaacauccccaacaugaacgagaccaaccccaccaccaccaacaucaccaacaucaucgucaacaagaacgaggagggcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggccggcaacauccuccgcacccaggaguccgagugcgucugccacaagggcaucugccccgucgucaugaccgacggccccgccaacaacaaggccgccaccaagaucaucuacuucaaggagggcaagauccagaagaucgaggagcuccagggcaacgcccagcacaucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgcccagaccgacacccaguccggccccaccuccuaccagcucaucgucaacaaccagaacugguccggcuacuccggcgccuucaucgacuacugggccaacaaggagugcuucaaccccugcuucuacgucgagcucauccgcggccgccccaaggaguccaacguccucuggaccuccaacuccauggucgcccucugcggcucccgcgagcgccucggcuccugguccuggcacgacgacgccgagaucaucuacuucaaguga

SEQ ID NO: 115948 - RNA, 1410 nt, Artificial Sequence
  derived and/or modified sequence opt2 from neuraminidase__InfluenzaA__AHJ57946
augaaccccaaccagaagaucaucaccaucggcuccgucucccucaccaucgccaccgucuccuuccucaugcagaucgccauccucaccaccaccgucacccuccacuucaagcacaacgagugcaacaugccccccaagaaccaggucauguccugcgagcccaucaucaucgagcgcaacaucaccgagaucgucuaccucaacaacaccaccgucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacaucugcaucaccggcgacgaccgcaacgccaccgccuccuucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucgacaucaacauggccgacuacuccaucgacucccacuacgucugcuccggccucgucggcgacaccccccgcaacgacgacaacuccuccuccuccaacugccgcgaccccaacaacgagcgcggcaaccccggcgucaagggcugggccuucgacgacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagccccgcgucugguggaccuccaacuccaucgucgucuucugcggcaccuccggcaccuacggcaccggcuccuggcccgacggcgccaacaucaacuucaugcccaucuga

SEQ ID NO: 115949 - RNA, 1410 nt, Artificial Sequence
  derived and/or modified sequence opt2 from neuraminidase__InfluenzaA__AHJ57957
augaaccccaaccagaagaucaucaccaucggcuccgucucccucaccaucgccaccgucuccuuccucaugcagaucgccauccucaccaccaccgucacccuccacuucaagcagaacgagugcaacaugccccccaagaaccaggucauguccugcgagcccaucaucaucgagcgcaacaucaccgagaucgucuaccucaacaacaccaccgucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacaucugcaucaccggcgacgaccgcaacgccaccgccuccuucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucgacaucaacauggccgacuacuccaucgacuccaacuacgucugcuccggccucgucggcgacaccccccgcaacgacgacaacuccuccuccuccaacugccgcgaccccaacaacgagcgcggcaaccccggcgucaagggcugggccuucgacuacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagccccgcgucugguggaccuccaacuccaucgucgucuucugcggcaccuccggcaccuacggcaccggcuccuggcccgacggcgccaacaucaacuucaugcccaucuga

SEQ ID NO: 115950 - RNA, 1410 nt, Artificial Sequence
  derived and/or modified sequence opt2 from neuraminidase__InfluenzaA__AHJ57968
augaaccccaaccagaagaucaucaccgucggcuccgucucccucgccaucgccaccaucugccuccucaugcagaucgccauccucgccaccaccgucacccuccacuucaagcagaacgagugcaacauccccuccaagaaccaggucaugcccugcgagcccaucaucaucgagcgcaacaucaccgaggucgucuaccucaacaacaccaucaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcucccccuccaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacgucugcaucaccggcgacgaccgcaacgccaccgccuccuucaucuacaacggcaugcucgucgacuccaucuccuccuggucccgcaacauccuccgcacccaggaguccgagugcgucugcaucaacggcaccugcaccgucaucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucgacaucaacauggccgacuacuccaucgacuccaacuacgucugcuccggccucgucggcgacaccccccgcaacgacgacaacuccuccuccuccaacugccgcgaccccaacaacgagcgcggcaaccccggcgucaagggcugggccuucgacgacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagacccgcgucugguggaccuccaacuccaucgucgucuucugcggcaccuccugcaccuacggcaccggcuccuggcccgacggcgccaacaucaacuucaugcccaucuga

SEQ ID NO: 115951 - RNA, 1413 nt, Artificial Sequence
  derived and/or modified sequence opt2 from neuraminidase__InfluenzaA__AHJ57980
augaaccccaaccagaagaacaccugcaucuccgccaucggcaugacccucuccgucgucucccuccucaucggcgucgccgaccucggccucaacaucggccuccacuacaaggucuccgacuccuccaacaucaacauccccaacaugaacgagaccaaccccaccaccaccaucaucaacaacaacccccagaacaacuucaccaacaucaccaacaucaucgucaacaagaacgaggaggagaaguuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacaagggcaucugccccgucgucaugaccgacggccccgccaacaaccgcgccgccaccaagaucaucuacuucaaggagggcaagauccagaagaucgaggagcucaagggcaacgcccagcacaucgaggagugcuccugcuacggcgccgccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccuccggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaucuccuaccagaccaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115952 - RNA, 1410 nt, Artificial Sequence
  derived and/or modified sequence opt2 from neuraminidase__InfluenzaA__AHJ57992
augaaccccaaccagaagaucaucaccaucggcuccgucucccucaccaucgccaccgucuccuuccucaugcagaucgccauccucaccaccaccgucacccuccacuucaagcacaacgagugcaacaugccccccaagaaccaggucauguccugcgagcccaucaucaucgagcgcaacaucaccgagaucgucuaccucaacaacaccaccgucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacaucugcaucaccggcgacgaccgcaacgccaccgccuccuucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucaacaucaacauggccgacuacuccaucgacuccaacuacgucugcuccggccucgucggcgacaccccccgcaacgacgacaacuccuccuccuccaacugccgcgaccccaacaacgagcgcggcaaccccggcgucaagggcugggccuucgacgacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagccccgcgucugguggaccuccaacuccaucgucgucuucugcggcaccuccggcaccuacggcaccggcuccuggcccgacggcgccaacaucaacuucaugcccaucuga

SEQ ID NO: 115953 - RNA, 1413 nt, Artificial Sequence
  derived and/or modified sequence opt2 from neuraminidase__InfluenzaA__AHJ58004
augaaccccaaccagaagaucaccugcaucuccgccaccggcgucacccucuccgucgucucccuccucaucggcaucgccaaccucggccucaacaucggccuccacuacaaggucuccgacuccuccaacaucaacauccccaacaugaacgagaccaaccccaccaccaccaucaucaacaaccacacccagaacaacuucaagaacaucaccaacaucaucgucaacaagaacgaggagggcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguaccgcggccgccccgucaccgagauccccuccugggccggcaacauccuccgcacccaggaguccgagugcgucugccacaagggcaucugccccgucgucaugaccgacggccccgccaacaaccgcgccgccaccaagaucaucuacuucaaggagggcaagauccagaagaucgaggagcucaagggcaacgcccagcacaucgaggagugcuccugcuacggcgccgccggcaugaucaagugcaucugccgcgacaacuggcgcggcgccaaccgccccgucaucaccaucgaccccgagaugaugacccacaccuccaaguaccucugcuccaagauccucaccgacaccucccgccccaacgaccccaccaacggcaacugcgacgagcccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccuccuaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115954 - RNA, 1413 nt, Artificial Sequence
  derived and/or modified sequence opt2 from neuraminidase__InfluenzaA__AHJ58016
augaaccccaaccagaagaucaccugcaucuccgccaccggcaugacccucuccgucgucuccaugcucaucggcaucgccaaccucggccucaacaucggccuccacuacaaggucuccgacuccaccaacaucaacauccccaagaugaacgagaccaaccccaccaccaccaucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcaagaacuccuggcucggccgcaccaucuccaaggacucccgcuccggcuacgagaugcucaagguccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuaccucaaguga

SEQ ID NO: 115955 - RNA, 1413 nt, Artificial Sequence
  derived and/or modified sequence opt2 from neuraminidase__InfluenzaA__AHJ58028
augaaccccaaccagaagaucaccugcaucuccgccaccggcaugacccucuccgucgucuccaugcucaucggcaucgccaaccucggccucaacaucggccuccacuacaaggucuccgacuccaccaacaucaacauccccaagaugaacgagaccaaccccaccaccaccaucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccguccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggccggcaacauccuccgcacccaggaguccgagugcgucugccacaagggcaucugccccgucgucaugaccgacggccccgccaacaaccgcgccgagaccaagaucaucuacuucaaggagggcaagauccagaagaucgaggagcucgagggcaacgcccagcacaucgaggagugcuccugcuacggcaccgccggcaugaucaagugcaucugccgcgacaacuggcgcggcgccaaccgccccgucaucaccaucgaccccgagaugaugacccacaccucccgcuaccucugcuccaagauccucaccgacaccucccgccccaacgaccccaccaacggcaacugcgacgcccccaucaccggcggcucccccgaccccggcgucaagggcuucgccuuccucgacggcaagaacuccuggcucggccgcaccaucuccaaggacucccgcuccggcuacgagaugcucaagguccccaacgccgagaccgacauccaguccggccccaccuccaaccagaucaucgucaacaaccagaacugguccggcuacuccggcgccuucaucgacuacugggccaacaaggagugcuucaaccccugcuucuacgucgagcucauccgcggccgccccaaggaguccaacguccucuggaccuccaacuccaucgucgcccucugcggcucccgcgagcgccucggcuccugguccuggcacgacggcgccgagaucaucuacuucaaguga

SEQ ID NO: 115956 - RNA, 1410 nt, Artificial Sequence
  derived and/or modified sequence opt2 from neuraminidase__InfluenzaA__AHJ58040
augaaccccaaccagaagaucaucaccgucggcuccgucucccucgccaucgccaccaucugccuccucaugcagaucgccauccucgccaccaccgucacccuccacuucaagcagaacgagugcaacauccccuccaagaaccaggucaugcccugcgagcccaucaucaucgagcgcaacaucaccgaggucgucuaccucaacaacaccaucaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcucccccuccaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacgucugcaucaccggcgacgaccgcaacgccaccgccuccuucaucuacaacggcaugcucgucgacuccaucuccuccuggucccgcaacauccuccgcacccaggaguccgagugcgucugcaucaacggcaccugcaccgucaucaugaccgacggcuccgccuccggcgucgccgacacccgcauccucuucauccgcgagggcaagaucguccacgucuccccccucuccggcuccgcccagcacaucgaggagugcuccugcuacccccgcuaccccgacguccgcugcgucugccgcgacaacuggaagggcuccaaccgccccgucgucgacaucaacauggccgacuacuccaucgacucccacuacgucugcuccggccucgucggcgacaccccccgcaacgacgacuccuccuccuccuccaacugcaaggaccccaacaacgagcgcggcaaccccggcgucaagggcugggccuucgacgacggcaacgacgucuggaugggccgcaccaucucccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 115957 - RNA, 1410 nt, Artificial Sequence
  derived and/or modified sequence opt2 from neuraminidase__InfluenzaA__AHJ58052
augaaccccaaccagaagaucaucaccaucggcuccgucucccucaccaucgccaccgucuccuuccucaugcagaucgccauccucaccaccaccgucacccuccacuucaagcacaacgagugcaacaugccccccaagaaccaggucauguccugcgagcccaucaucaucgagcgcaacaucaccgagaucgucuaccucaacaacaccaccgucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgacaacucccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacaucugcaucaccggcgacgaccgcaacgccaccgccuccuucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcauccucuucauccgcgagggcaagaucguccacaucuccccccucuccggcuccgcccagcacaucgaggagugcuccugcuacccccgcuaccccgacguccgcugcgucugccgcgacaacuggaagggcuccaaccgccccgucaucgacaucaacauggccgacuacuccaucgacuccaacuacgucugcuccggccucgucggcgacaccccccgcaacgacgacaacuccuccuccuccaacugccgcgaccccaacaacgagcgcggcaaccccggcgucaagggcugggccuucgacgacggcaacgacgucuggaugggccgcaccaucaaccgcgacucccgcuccggcuacgagaccuuccgcgucaucggcggcuggaccaccgccaacuccaagucccagaucaaccgccaggucaucgucgacaacaacaacugguccggcuacuccggcgucuucuccgucgagggcaaguccugcaucaaccgcugcuucuacgucgagcucauccgcggccgcccccaggagccccgcgucugguggaccuccaacuccaucgucgucuucugcggcaccuccggcaccuacggcaccggcuccuggcccgacggcgccaacaucaacuucaugcccaucuga

SEQ ID NO: 115958 - RNA, 1413 nt, Artificial Sequence
  derived and/or modified sequence opt2 from neuraminidase__InfluenzaA__AHJ58064
augaaccccaaccagaagaucaccugcaucuccgccaccggcaugacccucuccgucgucucccuccucaucggcaucgccaaccucggccucaacaucggccuccacuacaaggucuccgacuccaccaacaucaacauccccaacaugaacgagaccucccccaccaccaccaucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccagcacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaucaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaugaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115959 - RNA, 1401 nt, Artificial Sequence
  derived and/or modified sequence opt2 from neuraminidase__InfluenzaA__AHJ58075
augaaccccaaccagaagaucaucgccaucggcuccgucucccucaccaucgccaucaucugcuuccuccuccagaucgccauccucaccaccaccaugacccuccacuuccgccagaacgagugcuccaaccccuccaacaaccaggucguccccugcgagcccaucaucaucgagcgcaacaccguccaccucaacuccaccaccaucgagaaggagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcaucccccaccgcacccuccucaugaacgagcucggcguccccuuccaccucggcaccaagcaggucugcaucgccugguccuccuccuccugccacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcauccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcgacgacgacuccuccuccuccuccaacugccgcgaccccaacaacgagcgcggcgcccccggcgucaagggcugggccuucgacgacggcaacgacaucuggaugggccgcaccaucaaguccgacucccgcuccggcuacgagaccuuccgcgucgucaacggcuggaccaccgccaacuccaagucccagaucaaccgccaggucaucgucgacuccgacuccugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 115960 - RNA, 1413 nt, Artificial Sequence
  derived and/or modified sequence opt2 from neuraminidase__InfluenzaA__AHJ58087
augaaccccaaccagaagaucaccugcaucuccgccaccggcaugacccucuccgucgucucccuccucaucggcaucgccaaccucggccucaacaucggccuccacuacaaggucuccgacuccaccaacaucaacauccccaacaugaacgagaccucccccaccaccaccaucaucaacaaccacccccagaacaacuucaccaacaucaccaacaucaucgucaacaagaacgaggaggagaacuuccucaaccucaccaagccccucugcgaggucaacuccuggcacauccucuccaaggacaacgccauccgcaucggcgagaacgcccacauccucgucacccgcgagcccuaccucuccugcgacccccagggcugccgcauguucgcccucucccagggcaccacccuccgcggccagcacgccaacggcaccauccacgaccgcucccccuuccgcgcccucaucuccugggagaugggccaggcccccucccccuacaacgcccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagauccagaagaucgaggagcucaagggcaacgcccagcacaucgaggagugcuccugcuacggcgccuccggcaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaucaacggcaacugcgacgcccccaucaccggcggcucccccgaccccggcgucaagggcuucgccuuccucgacggcgacaacuccuggcucggccgcaccaucuccaaggacucccgcuccggcuacgagaugcucaagguccccaacgccgagaccgacacccaguccggcgccaucucccaccagaugaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcucccgcgagcgccucggcuccugguccuggcacgacggcgccgagaucaucuacuucaaguga

SEQ ID NO: 115961 - RNA, 1410 nt, Artificial Sequence
  derived and/or modified sequence opt2 from neuraminidase__InfluenzaA__AHL80721
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacgucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115962 - RNA, 1410 nt, Artificial Sequence
  derived and/or modified sequence opt2 from neuraminidase__InfluenzaA__AHL80732
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaucaucgacaaguga

SEQ ID NO: 115963 - RNA, 1410 nt, Artificial Sequence; identical to SEQ ID NO: 108250
  derived and/or modified sequence opt2 from neuraminidase__InfluenzaA__AHL80743

SEQ ID NO: 115964 - RNA, 1410 nt, Artificial Sequence
  derived and/or modified sequence opt2 from neuraminidase__InfluenzaA__AHL80754
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115965 - RNA, 1410 nt, Artificial Sequence; identical to SEQ ID NO: 108250
  derived and/or modified sequence opt2 from neuraminidase__InfluenzaA__AHL80765

SEQ ID NO: 115966 - RNA, 1410 nt, Artificial Sequence; identical to SEQ ID NO: 108250
  derived and/or modified sequence opt2 from neuraminidase__InfluenzaA__AHL80776

SEQ ID NO: 115967 - RNA, 1410 nt, Artificial Sequence; identical to SEQ ID NO: 108250
  derived and/or modified sequence opt2 from neuraminidase__InfluenzaA__AHL80787

SEQ ID NO: 115968 - RNA, 1410 nt, Artificial Sequence
  derived and/or modified sequence opt2 from neuraminidase__InfluenzaA__AHL80798
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccgucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115969 - RNA, 1410 nt, Artificial Sequence; identical to SEQ ID NO: 108250
  derived and/or modified sequence opt2 from neuraminidase__InfluenzaA__AHL80809

SEQ ID NO: 115970 - RNA, 1410 nt, Artificial Sequence; identical to SEQ ID NO: 108250
  derived and/or modified sequence opt2 from neuraminidase__InfluenzaA__AHL80820

SEQ ID NO: 115971 - RNA, 1410 nt, Artificial Sequence; identical to SEQ ID NO: 108250
  derived and/or modified sequence opt2 from neuraminidase__InfluenzaA__AHL80831

SEQ ID NO: 115972 - RNA, 1410 nt, Artificial Sequence; identical to SEQ ID NO: 108250
  derived and/or modified sequence opt2 from neuraminidase__InfluenzaA__AHL80842

SEQ ID NO: 115973 - RNA, 1410 nt, Artificial Sequence; identical to SEQ ID NO: 109538
  derived and/or modified sequence opt2 from neuraminidase__InfluenzaA__AHL80853

SEQ ID NO: 115974 - RNA, 1410 nt, Artificial Sequence
  derived and/or modified sequence opt2 from neuraminidase__InfluenzaA__AHL80864
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115975 - RNA, 1410 nt, Artificial Sequence; identical to SEQ ID NO: 109538
  derived and/or modified sequence opt2 from neuraminidase__InfluenzaA__AHL80875

SEQ ID NO: 115976 - RNA, 1410 nt, Artificial Sequence; identical to SEQ ID NO: 109538
  derived and/or modified sequence opt2 from neuraminidase__InfluenzaA__AHL80886

SEQ ID NO: 115977 - RNA, 1410 nt, Artificial Sequence
  derived and/or modified sequence opt2 from neuraminidase__InfluenzaA__AHL80897
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcaucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115978 - RNA, 1410 nt, Artificial Sequence
  derived and/or modified sequence opt2 from neuraminidase__InfluenzaA__AHL80908
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaccauccacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115979 - RNA, 1410 nt, Artificial Sequence
  derived and/or modified sequence opt2 from neuraminidase__InfluenzaA__AHL80919
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaccggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115980 - RNA, 1410 nt, Artificial Sequence; identical to SEQ ID NO: 111030
  derived and/or modified sequence opt2 from neuraminidase__InfluenzaA__AHL80930

SEQ ID NO: 115981 - RNA, 1410 nt, Artificial Sequence; identical to SEQ ID NO: 111030
  derived and/or modified sequence opt2 from neuraminidase__InfluenzaA__AHL80949

SEQ ID NO: 115982 - RNA, 1410 nt, Artificial Sequence
  derived and/or modified sequence opt2 from neuraminidase__InfluenzaA__AHL80961
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacgucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 115983 - RNA, 1410 nt, Artificial Sequence; identical to SEQ ID NO: 115982
  derived and/or modified sequence opt2 from neuraminidase__InfluenzaA__AHL80972

SEQ ID NO: 115984 - RNA, 1410 nt, Artificial Sequence; identical to SEQ ID NO: 111030
  derived and/or modified sequence opt2 from neuraminidase__InfluenzaA__AHL80983

SEQ ID NO: 115985 - RNA, 1410 nt, Artificial Sequence; identical to SEQ ID NO: 111030
  derived and/or modified sequence opt2 from neuraminidase__InfluenzaA__AHL80992

SEQ ID NO: 115986 - RNA, 1410 nt, Artificial Sequence; identical to SEQ ID NO: 111030
  derived and/or modified sequence opt2 from neuraminidase__InfluenzaA__AHL81004

SEQ ID NO: 115987 - RNA, 1410 nt, Artificial Sequence
  derived and/or modified sequence opt2 from neuraminidase__InfluenzaA__AHL81016
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgacuccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115988 - RNA, 1410 nt, Artificial Sequence; identical to SEQ ID NO: 111030
  derived and/or modified sequence opt2 from neuraminidase__InfluenzaA__AHL81028

SEQ ID NO: 115989 - RNA, 1410 nt, Artificial Sequence; identical to SEQ ID NO: 111030
  derived and/or modified sequence opt2 from neuraminidase__InfluenzaA__AHL81040

SEQ ID NO: 115990 - RNA, 1410 nt, Artificial Sequence; identical to SEQ ID NO: 111030
  derived and/or modified sequence opt2 from neuraminidase__InfluenzaA__AHL81052

SEQ ID NO: 115991 - RNA, 1410 nt, Artificial Sequence; identical to SEQ ID NO: 115982
  derived and/or modified sequence opt2 from neuraminidase__InfluenzaA__AHL81064

SEQ ID NO: 115992 - RNA, 1410 nt, Artificial Sequence; identical to SEQ ID NO: 115982
  derived and/or modified sequence opt2 from neuraminidase__InfluenzaA__AHL81075

SEQ ID NO: 115993 - RNA, 1410 nt, Artificial Sequence
  derived and/or modified sequence opt2 from neuraminidase__InfluenzaA__AHL81086
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcaagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115994 - RNA, 1410 nt, Artificial Sequence
  derived and/or modified sequence opt2 from neuraminidase__InfluenzaA__AHL81098
augaaccccaaccagaagaucaucaccaucggcuccgucucccucaccaucuccaccaucugcuucuucguccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 115995 - RNA, 1410 nt, Artificial Sequence; identical to SEQ ID NO: 112221
  derived and/or modified sequence opt2 from neuraminidase__InfluenzaA__AHL81110

SEQ ID NO: 115996 - RNA, 1410 nt, Artificial Sequence; identical to SEQ ID NO: 112221
  derived and/or modified sequence opt2 from neuraminidase__InfluenzaA__AHL81121

SEQ ID NO: 115997 - RNA, 1410 nt, Artificial Sequence; identical to SEQ ID NO: 111030
  derived and/or modified sequence opt2 from neuraminidase__InfluenzaA__AHL81132

SEQ ID NO: 115998 - RNA, 1410 nt, Artificial Sequence; identical to SEQ ID NO: 111030
  derived and/or modified sequence opt2 from neuraminidase__InfluenzaA__AHL81144

SEQ ID NO: 115999 - RNA, 1410 nt, Artificial Sequence; identical to SEQ ID NO: 111030
  derived and/or modified sequence opt2 from neuraminidase__InfluenzaA__AHL81156

SEQ ID NO: 116000 - RNA, 1410 nt, Artificial Sequence; identical to SEQ ID NO: 113299
  derived and/or modified sequence opt2 from neuraminidase__InfluenzaA__AHL81168

SEQ ID NO: 116001 - RNA, 1410 nt, Artificial Sequence; identical to SEQ ID NO: 113299
  derived and/or modified sequence opt2 from neuraminidase__InfluenzaA__AHL81180

SEQ ID NO: 116002 - RNA, 1410 nt, Artificial Sequence; identical to SEQ ID NO: 111030
  derived and/or modified sequence opt2 from neuraminidase__InfluenzaA__AHL81192

SEQ ID NO: 116003 - RNA, 1410 nt, Artificial Sequence
  derived and/or modified sequence opt2 from neuraminidase__InfluenzaA__AHL81215
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucauguaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaacuucaugcccaucuga

SEQ ID NO: 116004 - RNA, 1410 nt, Artificial Sequence
  derived and/or modified sequence opt2 from neuraminidase__InfluenzaA__AHL81227
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaccggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116005 - RNA, 1410 nt, Artificial Sequence; identical to SEQ ID NO: 111030
  derived and/or modified sequence opt2 from neuraminidase__InfluenzaA__AHL81238

SEQ ID NO: 116006 - RNA, 1410 nt, Artificial Sequence; identical to SEQ ID NO: 111030
  derived and/or modified sequence opt2 from neuraminidase__InfluenzaA__AHL81250

SEQ ID NO: 116007 - RNA, 1410 nt, Artificial Sequence; identical to SEQ ID NO: 111030
  derived and/or modified sequence opt2 from neuraminidase__InfluenzaA__AHL81262

SEQ ID NO: 116008 - RNA, 1410 nt, Artificial Sequence; identical to SEQ ID NO: 111030
  derived and/or modified sequence opt2 from neuraminidase__InfluenzaA__AHL81274

SEQ ID NO: 116009 - RNA, 1410 nt, Artificial Sequence; identical to SEQ ID NO: 111030
  derived and/or modified sequence opt2 from neuraminidase__InfluenzaA__AHL81286

SEQ ID NO: 116010 - RNA, 1410 nt, Artificial Sequence; identical to SEQ ID NO: 111030
  derived and/or modified sequence opt2 from neuraminidase__InfluenzaA__AHL81298

SEQ ID NO: 116011 - RNA, 1410 nt, Artificial Sequence; identical to SEQ ID NO: 115982
  derived and/or modified sequence opt2 from neuraminidase__InfluenzaA__AHL81310

SEQ ID NO: 116012 - RNA, 1410 nt, Artificial Sequence; identical to SEQ ID NO: 112221
  derived and/or modified sequence opt2 from neuraminidase__InfluenzaA__AHL81332

SEQ ID NO: 116013 - RNA, 1410 nt, Artificial Sequence
  derived and/or modified sequence opt2 from neuraminidase__InfluenzaA__AHL81343
augaaccccaaccagaagaucaucaccaucggcuccgucucccucaccaucuccaccaucugcuuccucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaucaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugcuccgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116014 - RNA, 1410 nt, Artificial Sequence; identical to SEQ ID NO: 111030
  derived and/or modified sequence opt2 from neuraminidase__InfluenzaA__AHL81355

SEQ ID NO: 116015 - RNA, 1410 nt, Artificial Sequence; identical to SEQ ID NO: 112221
  derived and/or modified sequence opt2 from neuraminidase__InfluenzaA__AHL81367

SEQ ID NO: 116016 - RNA, 1410 nt, Artificial Sequence; identical to SEQ ID NO: 112221
  derived and/or modified sequence opt2 from neuraminidase__InfluenzaA__AHL81378

SEQ ID NO: 116017 - RNA, 1410 nt, Artificial Sequence; identical to SEQ ID NO: 112221
  derived and/or modified sequence opt2 from neuraminidase__InfluenzaA__AHL81389

SEQ ID NO: 116018 - RNA, 1410 nt, Artificial Sequence; identical to SEQ ID NO: 111030
  derived and/or modified sequence opt2 from neuraminidase__InfluenzaA__AHL81400

SEQ ID NO: 116019 - RNA, 1410 nt, Artificial Sequence; identical to SEQ ID NO: 116003
  derived and/or modified sequence opt2 from neuraminidase__InfluenzaA__AHL81412

SEQ ID NO: 116020 - RNA, 1410 nt, Artificial Sequence; identical to SEQ ID NO: 108250
  derived and/or modified sequence opt2 from neuraminidase__InfluenzaA__AHL81422

SEQ ID NO: 116021 - RNA, 1410 nt, Artificial Sequence; identical to SEQ ID NO: 109538
  derived and/or modified sequence opt2 from neuraminidase__InfluenzaA__AHL81433

SEQ ID NO: 116022 - RNA, 1410 nt, Artificial Sequence
  derived and/or modified sequence opt2 from neuraminidase__InfluenzaA__AHL88954
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116023 - RNA, 1410 nt, Artificial Sequence
  derived and/or modified sequence opt2 from neuraminidase__InfluenzaA__AHL89033
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgaggacaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116024 - RNA, 1410 nt, Artificial Sequence
  derived and/or modified sequence opt2 from neuraminidase__InfluenzaA__AHL89045
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgccaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116025 - RNA, 1410 nt, Artificial Sequence
  derived and/or modified sequence opt2 from neuraminidase__InfluenzaA__AHL89057
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116026 - RNA, 1410 nt, Artificial Sequence; identical to SEQ ID NO: 107219
  derived and/or modified sequence opt2 from neuraminidase__InfluenzaA__AHL89069

SEQ ID NO: 116027 - RNA, 1410 nt, Artificial Sequence; identical to SEQ ID NO: 106224
  derived and/or modified sequence opt2 from neuraminidase__InfluenzaA__AHL89081

SEQ ID NO: 116028 - RNA, 1410 nt, Artificial Sequence; identical to SEQ ID NO: 106224
  derived and/or modified sequence opt2 from neuraminidase__InfluenzaA__AHL89093

SEQ ID NO: 116029 - RNA, 1410 nt, Artificial Sequence; identical to SEQ ID NO: 106224
  derived and/or modified sequence opt2 from neuraminidase__InfluenzaA__AHL89117

SEQ ID NO: 116030 - RNA, 1410 nt, Artificial Sequence; identical to SEQ ID NO: 106224
  derived and/or modified sequence opt2 from neuraminidase__InfluenzaA__AHL89129

SEQ ID NO: 116031 - RNA, 1410 nt, Artificial Sequence
  derived and/or modified sequence opt2 from neuraminidase__InfluenzaA__AHL89141
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116032 - RNA, 1410 nt, Artificial Sequence
  derived and/or modified sequence opt2 from neuraminidase__InfluenzaA__AHL89153
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucucccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116033 - RNA, 1410 nt, Artificial Sequence; identical to SEQ ID NO: 106224
  derived and/or modified sequence opt2 from neuraminidase__InfluenzaA__AHL89165

SEQ ID NO: 116034 - RNA, 1410 nt, Artificial Sequence
  derived and/or modified sequence opt2 from neuraminidase__InfluenzaA__AHL89177
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaacgagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 116035 - RNA, 1410 nt, Artificial Sequence; identical to SEQ ID NO: 108076
  derived and/or modified sequence opt2 from neuraminidase__InfluenzaA__AHL89189

SEQ ID NO: 116036 - RNA, 1410 nt, Artificial Sequence; identical to SEQ ID NO: 107219
  derived and/or modified sequence opt2 from neuraminidase__InfluenzaA__AHL89201

SEQ ID NO: 116037 - RNA, 1410 nt, Artificial Sequence; identical to SEQ ID NO: 108076
  derived and/or modified sequence opt2 from neuraminidase__InfluenzaA__AHL89213

SEQ ID NO: 116038 - RNA, 1410 nt, Artificial Sequence
  derived and/or modified sequence opt2 from neuraminidase__InfluenzaA__AHL89225
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116039 - RNA, 1410 nt, Artificial Sequence; identical to SEQ ID NO: 108076
  derived and/or modified sequence opt2 from neuraminidase__InfluenzaA__AHL89237

SEQ ID NO: 116040 - RNA, 1410 nt, Artificial Sequence; identical to SEQ ID NO: 107219
  derived and/or modified sequence opt2 from neuraminidase__InfluenzaA__AHL89261

SEQ ID NO: 116041 - RNA, 1410 nt, Artificial Sequence
  derived and/or modified sequence opt2 from neuraminidase__InfluenzaA__AHL89273
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 116042 - RNA, 1410 nt, Artificial Sequence
  derived and/or modified sequence opt2 from neuraminidase__InfluenzaA__AHL89285
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcuccaccuccggcaccuacggcaccggcuccuggcccgacggcgccgacaucaaccucaugcccaucuga

SEQ ID NO: 116043 - RNA, 1410 nt, Artificial Sequence; identical to SEQ ID NO: 116041
  derived and/or modified sequence opt2 from neuraminidase__InfluenzaA__AHL89297

SEQ ID NO: 116044 - RNA, 1410 nt, Artificial Sequence; identical to SEQ ID NO: 116041
  derived and/or modified sequence opt2 from neuraminidase__InfluenzaA__AHL89309

SEQ ID NO: 116045 - RNA, 1410 nt, Artificial Sequence
  derived and/or modified sequence opt2 from neuraminidase__InfluenzaA__AHL89321
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116046 - RNA, 1410 nt, Artificial Sequence
  derived and/or modified sequence opt2 from neuraminidase__InfluenzaA__AHL89333
augaaccccaaccagaagaucaucaccaucggcuccgucucccucaccaucuccaccaucugcuucuucaugcagaucgccauccucaucgccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116047 - RNA, 1410 nt, Artificial Sequence; identical to SEQ ID NO: 106224
  derived and/or modified sequence opt2 from neuraminidase__InfluenzaA__AHL89345

SEQ ID NO: 116048 - RNA, 1410 nt, Artificial Sequence; identical to SEQ ID NO: 107218
  derived and/or modified sequence opt2 from neuraminidase__InfluenzaA__AHL89357

SEQ ID NO: 116049 - RNA, 1410 nt, Artificial Sequence; identical to SEQ ID NO: 107219
  derived and/or modified sequence opt2 from neuraminidase__InfluenzaA__AHL89369

SEQ ID NO: 116050 - RNA, 1410 nt, Artificial Sequence
  derived and/or modified sequence opt2 from neuraminidase__InfluenzaA__AHL89381
augaaccccaaccagaagaucaucaccaucggcuccgucucccucaccaucuccaccaucugcuucuucaugcagaucgccauccucaucaccaccgucacccuccacuucaagcaguacgaguacaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116051 - RNA, 1410 nt, Artificial Sequence; identical to SEQ ID NO: 116041
  derived and/or modified sequence opt2 from neuraminidase__InfluenzaA__AHL89405

SEQ ID NO: 116052 - RNA, 1410 nt, Artificial Sequence
  derived and/or modified sequence opt2 from neuraminidase__InfluenzaA__AHL89417
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucgacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116053 - RNA, 1410 nt, Artificial Sequence; identical to SEQ ID NO: 107219
  derived and/or modified sequence opt2 from neuraminidase__InfluenzaA__AHL89429

SEQ ID NO: 116054 - RNA, 1410 nt, Artificial Sequence; identical to SEQ ID NO: 106224
  derived and/or modified sequence opt2 from neuraminidase__InfluenzaA__AHL89441

SEQ ID NO: 116055 - RNA, 1410 nt, Artificial Sequence; identical to SEQ ID NO: 106224
  derived and/or modified sequence opt2 from neuraminidase__InfluenzaA__AHL89453

SEQ ID NO: 116056 - RNA, 1410 nt, Artificial Sequence
  derived and/or modified sequence opt2 from neuraminidase__InfluenzaA__AHL89465
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaucaccaucgagaaggagaagugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgaccgcugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116057 - RNA, 1410 nt, Artificial Sequence; identical to SEQ ID NO: 116031
  derived and/or modified sequence opt2 from neuraminidase__InfluenzaA__AHL89477

SEQ ID NO: 116058 - RNA, 1410 nt, Artificial Sequence
  derived and/or modified sequence opt2 from neuraminidase__InfluenzaA__AHL89489
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcuccaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgaccgcuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaacccccacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116059 - RNA, 1410 nt, Artificial Sequence; identical to SEQ ID NO: 107219
  derived and/or modified sequence opt2 from neuraminidase__InfluenzaA__AHL89501

SEQ ID NO: 116060 - RNA, 1410 nt, Artificial Sequence; identical to SEQ ID NO: 107219
  derived and/or modified sequence opt2 from neuraminidase__InfluenzaA__AHL89513

SEQ ID NO: 116061 - RNA, 1410 nt, Artificial Sequence; identical to SEQ ID NO: 107219
  derived and/or modified sequence opt2 from neuraminidase__InfluenzaA__AHL89525

SEQ ID NO: 116062 - RNA, 1410 nt, Artificial Sequence; identical to SEQ ID NO: 107219
  derived and/or modified sequence opt2 from neuraminidase__InfluenzaA__AHL89537

SEQ ID NO: 116063 - RNA, 1413 nt, Artificial Sequence
  derived and/or modified sequence opt2 from neuraminidase__InfluenzaA__AHL89549
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagcaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 116064 - RNA, 1413 nt, Artificial Sequence; identical to SEQ ID NO: 107542
  derived and/or modified sequence opt2 from neuraminidase__InfluenzaA__AHL89561

SEQ ID NO: 116065 - RNA, 1413 nt, Artificial Sequence; identical to SEQ ID NO: 107542
  derived and/or modified sequence opt2 from neuraminidase__InfluenzaA__AHL89573

SEQ ID NO: 116066 - RNA, 1413 nt, Artificial Sequence; identical to SEQ ID NO: 107577
  derived and/or modified sequence opt2 from neuraminidase__InfluenzaA__AHL89585

SEQ ID NO: 116067 - RNA, 1413 nt, Artificial Sequence
  derived and/or modified sequence opt2 from neuraminidase__InfluenzaA__AHL89597
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccguccgcgaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 116068 - RNA, 1413 nt, Artificial Sequence; identical to SEQ ID NO: 107577
  derived and/or modified sequence opt2 from neuraminidase__InfluenzaA__AHL89609

SEQ ID NO: 116069 - RNA, 1413 nt, Artificial Sequence
  derived and/or modified sequence opt2 from neuraminidase__InfluenzaA__AHL89621
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccaccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 116070 - RNA, 1413 nt, Artificial Sequence; identical to SEQ ID NO: 107568
  derived and/or modified sequence opt2 from neuraminidase__InfluenzaA__AHL89633

SEQ ID NO: 116071 - RNA, 1413 nt, Artificial Sequence; identical to SEQ ID NO: 107577
  derived and/or modified sequence opt2 from neuraminidase__InfluenzaA__AHL89645

SEQ ID NO: 116072 - RNA, 1413 nt, Artificial Sequence; identical to SEQ ID NO: 107542
  derived and/or modified sequence opt2 from neuraminidase__InfluenzaA__AHL89657

SEQ ID NO: 116073 - RNA, 1413 nt, Artificial Sequence
  derived and/or modified sequence opt2 from neuraminidase__InfluenzaA__AHL89669
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacgagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 116074 - RNA, 1413 nt, Artificial Sequence
  derived and/or modified sequence opt2 from neuraminidase__InfluenzaA__AHL89681
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaagaucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacgccaccaucuggaccuccggcuccuccaucuccuucugcggcgucgacuccgacaccgccaacugguccuggcccgacggcgccgagcuccccuucaccaucgacaaguga

SEQ ID NO: 116075 - RNA, 1413 nt, Artificial Sequence
  derived and/or modified sequence opt2 from neuraminidase__InfluenzaA__AHL89693
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaagggcaucaucaccggcaccaucaaguccuggcgcaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacgacgacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116076 - RNA, 1413 nt, Artificial Sequence
  derived and/or modified sequence opt2 from neuraminidase__InfluenzaA__AHL89705
augaaccccaaccagaagaucaucaccaucggcuccaucuccaucgccaucggcaucaucucccucaugcuccagaucggcaacaucaucuccaucugggccucccacuccauccagaacggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 116077 - RNA, 1413 nt, Artificial Sequence; identical to SEQ ID NO: 107542
  derived and/or modified sequence opt2 from neuraminidase__InfluenzaA__AHL89717

SEQ ID NO: 116078 - RNA, 1413 nt, Artificial Sequence; identical to SEQ ID NO: 107542
  derived and/or modified sequence opt2 from neuraminidase__InfluenzaA__AHL89729

SEQ ID NO: 116079 - RNA, 1413 nt, Artificial Sequence
  derived and/or modified sequence opt2 from neuraminidase__InfluenzaA__AHL89753
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaacgacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 116080 - RNA, 1413 nt, Artificial Sequence; identical to SEQ ID NO: 107542
  derived and/or modified sequence opt2 from neuraminidase__InfluenzaA__AHL89765

SEQ ID NO: 116081 - RNA, 1413 nt, Artificial Sequence; identical to SEQ ID NO: 107583
  derived and/or modified sequence opt2 from neuraminidase__InfluenzaA__AHL89777

SEQ ID NO: 116082 - RNA, 1413 nt, Artificial Sequence; identical to SEQ ID NO: 107542
  derived and/or modified sequence opt2 from neuraminidase__InfluenzaA__AHL89789

SEQ ID NO: 116083 - RNA, 1413 nt, Artificial Sequence
  derived and/or modified sequence opt2 from neuraminidase__InfluenzaA__AHL89801
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucgcccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 116084 - RNA, 1413 nt, Artificial Sequence
  derived and/or modified sequence opt2 from neuraminidase__InfluenzaA__AHL89813
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgccgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacgccaccaucuggaccuccggcuccuccaucuccuucugcggcgucgacuccgacaccgccaacugguccuggcccgacggcgccgagcuccccuucaccaucgacaaguga

SEQ ID NO: 116085 - RNA, 1413 nt, Artificial Sequence; identical to SEQ ID NO: 107583
  derived and/or modified sequence opt2 from neuraminidase__InfluenzaA__AHL89825

SEQ ID NO: 116086 - RNA, 1413 nt, Artificial Sequence; identical to SEQ ID NO: 107542
  derived and/or modified sequence opt2 from neuraminidase__InfluenzaA__AHL89837

SEQ ID NO: 116087 - RNA, 1413 nt, Artificial Sequence
  derived and/or modified sequence opt2 from neuraminidase__InfluenzaA__AHL89849
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcauggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 116088 - RNA, 1410 nt, Artificial Sequence; identical to SEQ ID NO: 107578
  derived and/or modified sequence opt2 from neuraminidase__InfluenzaA__AHL89861

SEQ ID NO: 116089 - RNA, 1410 nt, Artificial Sequence
  derived and/or modified sequence opt2 from neuraminidase__InfluenzaA__AHL89873
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgacggcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116090 - RNA, 1410 nt, Artificial Sequence; identical to SEQ ID NO: 108255
  derived and/or modified sequence opt2 from neuraminidase__InfluenzaA__AHL89885

SEQ ID NO: 116091 - RNA, 1410 nt, Artificial Sequence
  derived and/or modified sequence opt2 from neuraminidase__InfluenzaA__AHL89897
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116092 - RNA, 1410 nt, Artificial Sequence; identical to SEQ ID NO: 107914
  derived and/or modified sequence opt2 from neuraminidase__InfluenzaA__AHL89909

SEQ ID NO: 116093 - RNA, 1410 nt, Artificial Sequence; identical to SEQ ID NO: 107553
  derived and/or modified sequence opt2 from neuraminidase__InfluenzaA__AHL89921

SEQ ID NO: 116094 - RNA, 1410 nt, Artificial Sequence; identical to SEQ ID NO: 107914
  derived and/or modified sequence opt2 from neuraminidase__InfluenzaA__AHL89933

SEQ ID NO: 116095 - RNA, 1410 nt, Artificial Sequence; identical to SEQ ID NO: 107553
  derived and/or modified sequence opt2 from neuraminidase__InfluenzaA__AHL89945

SEQ ID NO: 116096 - RNA, 1410 nt, Artificial Sequence
  derived and/or modified sequence opt2 from neuraminidase__InfluenzaA__AHL89957
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116097 - RNA, 1410 nt, Artificial Sequence; identical to SEQ ID NO: 107396
  derived and/or modified sequence opt2 from neuraminidase__InfluenzaA__AHL89969

SEQ ID NO: 116098 - RNA, 1410 nt, Artificial Sequence; identical to SEQ ID NO: 107396
  derived and/or modified sequence opt2 from neuraminidase__InfluenzaA__AHL89981

SEQ ID NO: 116099 - RNA, 1410 nt, Artificial Sequence
  derived and/or modified sequence opt2 from neuraminidase__InfluenzaA__AHL89993
augaaccccaaccagaagaucaucaccaucggcuccgucucccucuccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcacccucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116100 - RNA, 1410 nt, Artificial Sequence
  derived and/or modified sequence opt2 from neuraminidase__InfluenzaA__AHL90005
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucaagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuacuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116101 - RNA, 1410 nt, Artificial Sequence; identical to SEQ ID NO: 107602
  derived and/or modified sequence opt2 from neuraminidase__InfluenzaA__AHL90017

SEQ ID NO: 116102 - RNA, 1410 nt, Artificial Sequence; identical to SEQ ID NO: 107553
  derived and/or modified sequence opt2 from neuraminidase__InfluenzaA__AHL90029

SEQ ID NO: 116103 - RNA, 1410 nt, Artificial Sequence; identical to SEQ ID NO: 107569
  derived and/or modified sequence opt2 from neuraminidase__InfluenzaA__AHL90041

SEQ ID NO: 116104 - RNA, 1410 nt, Artificial Sequence; identical to SEQ ID NO: 107569
  derived and/or modified sequence opt2 from neuraminidase__InfluenzaA__AHL90053

SEQ ID NO: 116105 - RNA, 1410 nt, Artificial Sequence; identical to SEQ ID NO: 113834
  derived and/or modified sequence opt2 from neuraminidase__InfluenzaA__AHL90065

SEQ ID NO: 116106 - RNA, 1410 nt, Artificial Sequence; identical to SEQ ID NO: 116096
  derived and/or modified sequence opt2 from neuraminidase__InfluenzaA__AHL90077

SEQ ID NO: 116107 - RNA, 1410 nt, Artificial Sequence; identical to SEQ ID NO: 107578
  derived and/or modified sequence opt2 from neuraminidase__InfluenzaA__AHL90089

SEQ ID NO: 116108 - RNA, 1410 nt, Artificial Sequence; identical to SEQ ID NO: 108255
  derived and/or modified sequence opt2 from neuraminidase__InfluenzaA__AHL90101

SEQ ID NO: 116109 - RNA, 1410 nt, Artificial Sequence; identical to SEQ ID NO: 107553
  derived and/or modified sequence opt2 from neuraminidase__InfluenzaA__AHL90113

SEQ ID NO: 116110 - RNA, 1413 nt, Artificial Sequence; identical to SEQ ID NO: 108144
  derived and/or modified sequence opt2 from neuraminidase__InfluenzaA__AHL90125

SEQ ID NO: 116111 - RNA, 1413 nt, Artificial Sequence
  derived and/or modified sequence opt2 from neuraminidase__InfluenzaA__AHL90136
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacuccggcauggucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116112 - RNA, 1413 nt, Artificial Sequence; identical to SEQ ID NO: 108144
  derived and/or modified sequence opt2 from neuraminidase__InfluenzaA__AHL90160

SEQ ID NO: 116113 - RNA, 1413 nt, Artificial Sequence
  derived and/or modified sequence opt2 from neuraminidase__InfluenzaA__AHL90172
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcaacugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116114 - RNA, 1413 nt, Artificial Sequence; identical to SEQ ID NO: 108144
  derived and/or modified sequence opt2 from neuraminidase__InfluenzaA__AHL90184

SEQ ID NO: 116115 - RNA, 1413 nt, Artificial Sequence; identical to SEQ ID NO: 111442
  derived and/or modified sequence opt2 from neuraminidase__InfluenzaA__AHL90196

SEQ ID NO: 116116 - RNA, 1413 nt, Artificial Sequence; identical to SEQ ID NO: 108144
  derived and/or modified sequence opt2 from neuraminidase__InfluenzaA__AHL90220

SEQ ID NO: 116117 - RNA, 1413 nt, Artificial Sequence
  derived and/or modified sequence opt2 from neuraminidase__InfluenzaA__AHL90232
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116118 - RNA, 1413 nt, Artificial Sequence
  derived and/or modified sequence opt2 from neuraminidase__InfluenzaA__AHL90244
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccaugaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccuccugguccuggcccgacggcgccgagcuccccuucaccaucgacaaguga

SEQ ID NO: 116119 - RNA, 1413 nt, Artificial Sequence; identical to SEQ ID NO: 108973
  derived and/or modified sequence opt2 from neuraminidase__InfluenzaA__AHL90256

SEQ ID NO: 116120 - RNA, 1413 nt, Artificial Sequence
  derived and/or modified sequence opt2 from neuraminidase__InfluenzaA__AHL90268
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccuccaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgaccgcgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116121 - RNA, 1413 nt, Artificial Sequence; identical to SEQ ID NO: 108973
  derived and/or modified sequence opt2 from neuraminidase__InfluenzaA__AHL90280

SEQ ID NO: 116122 - RNA, 1413 nt, Artificial Sequence
  derived and/or modified sequence opt2 from neuraminidase__InfluenzaA__AHL90304
augaaccccaaccagaagaucaucaccaucggcuccaucuccaucgccaucggcaucaucucccucaugcuccagaucggcaacaucaucuccaucugggccucccacuccauccagaccggcucccagaacaacaccgagaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116123 - RNA, 1413 nt, Artificial Sequence; identical to SEQ ID NO: 108144
  derived and/or modified sequence opt2 from neuraminidase__InfluenzaA__AHL90316

SEQ ID NO: 116124 - RNA, 1413 nt, Artificial Sequence
  derived and/or modified sequence opt2 from neuraminidase__InfluenzaA__AHL90328
augaaccccaacaagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccgucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116125 - RNA, 1413 nt, Artificial Sequence; identical to SEQ ID NO: 108144
  derived and/or modified sequence opt2 from neuraminidase__InfluenzaA__AHL90340

SEQ ID NO: 116126 - RNA, 1413 nt, Artificial Sequence
  derived and/or modified sequence opt2 from neuraminidase__InfluenzaA__AHL90352
augaaccccaaccagaagaucaugaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcucccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggcaugccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116127 - RNA, 1413 nt, Artificial Sequence; identical to SEQ ID NO: 114973
  derived and/or modified sequence opt2 from neuraminidase__InfluenzaA__AHL90364

SEQ ID NO: 116128 - RNA, 1413 nt, Artificial Sequence; identical to SEQ ID NO: 108973
  derived and/or modified sequence opt2 from neuraminidase__InfluenzaA__AHL90376

SEQ ID NO: 116129 - RNA, 1410 nt, Artificial Sequence
  derived and/or modified sequence opt2 from neuraminidase__InfluenzaA__AHL90388
augaaccccaaccagaagaucaucaccaucggcuccgucucccucaucaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaucaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116130 - RNA, 1410 nt, Artificial Sequence; identical to SEQ ID NO: 108024
  derived and/or modified sequence opt2 from neuraminidase__InfluenzaA__AHL90400

SEQ ID NO: 116131 - RNA, 1410 nt, Artificial Sequence; identical to SEQ ID NO: 108024
  derived and/or modified sequence opt2 from neuraminidase__InfluenzaA__AHL90413

SEQ ID NO: 116132 - RNA, 1410 nt, Artificial Sequence
  derived and/or modified sequence opt2 from neuraminidase__InfluenzaA__AHL90425
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116133 - RNA, 1410 nt, Artificial Sequence; identical to SEQ ID NO: 108111
  derived and/or modified sequence opt2 from neuraminidase__InfluenzaA__AHL90437

SEQ ID NO: 116134 - RNA, 1410 nt, Artificial Sequence; identical to SEQ ID NO: 108024
  derived and/or modified sequence opt2 from neuraminidase__InfluenzaA__AHL90449

SEQ ID NO: 116135 - RNA, 1410 nt, Artificial Sequence; identical to SEQ ID NO: 108024
  derived and/or modified sequence opt2 from neuraminidase__InfluenzaA__AHL90461

SEQ ID NO: 116136 - RNA, 1410 nt, Artificial Sequence; identical to SEQ ID NO: 108024
  derived and/or modified sequence opt2 from neuraminidase__InfluenzaA__AHL90473

SEQ ID NO: 116137 - RNA, 1410 nt, Artificial Sequence; identical to SEQ ID NO: 108024
  derived and/or modified sequence opt2 from neuraminidase__InfluenzaA__AHL90485

SEQ ID NO: 116138 - RNA, 1410 nt, Artificial Sequence; identical to SEQ ID NO: 108115
  derived and/or modified sequence opt2 from neuraminidase__InfluenzaA__AHL90497

SEQ ID NO: 116139 - RNA, 1410 nt, Artificial Sequence; identical to SEQ ID NO: 108115
  derived and/or modified sequence opt2 from neuraminidase__InfluenzaA__AHL90509

SEQ ID NO: 116140 - RNA, 1410 nt, Artificial Sequence
  derived and/or modified sequence opt2 from neuraminidase__InfluenzaA__AHL90521
augaaccccaaccagaagaucaucaccaucggcuccgucucccucaccaucuccaccaucugcuucuuccuccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116141 - RNA, 1410 nt, Artificial Sequence
  derived and/or modified sequence opt2 from neuraminidase__InfluenzaA__AHL90533
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgagcgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116142 - RNA, 1410 nt, Artificial Sequence; identical to SEQ ID NO: 108024
  derived and/or modified sequence opt2 from neuraminidase__InfluenzaA__AHL90545

SEQ ID NO: 116143 - RNA, 1410 nt, Artificial Sequence; identical to SEQ ID NO: 108111
  derived and/or modified sequence opt2 from neuraminidase__InfluenzaA__AHL90557

SEQ ID NO: 116144 - RNA, 1410 nt, Artificial Sequence
  derived and/or modified sequence opt2 from neuraminidase__InfluenzaA__AHL90569
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaagggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116145 - RNA, 1410 nt, Artificial Sequence; identical to SEQ ID NO: 108111
  derived and/or modified sequence opt2 from neuraminidase__InfluenzaA__AHL90581

SEQ ID NO: 116146 - RNA, 1410 nt, Artificial Sequence; identical to SEQ ID NO: 108115
  derived and/or modified sequence opt2 from neuraminidase__InfluenzaA__AHL90593

SEQ ID NO: 116147 - RNA, 1410 nt, Artificial Sequence
  derived and/or modified sequence opt2 from neuraminidase__InfluenzaA__AHL90605
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 116148 - RNA, 1410 nt, Artificial Sequence; identical to SEQ ID NO: 108111
  derived and/or modified sequence opt2 from neuraminidase__InfluenzaA__AHL90629

SEQ ID NO: 116149 - RNA, 1410 nt, Artificial Sequence; identical to SEQ ID NO: 108111
  derived and/or modified sequence opt2 from neuraminidase__InfluenzaA__AHL90641

SEQ ID NO: 116150 - RNA, 1410 nt, Artificial Sequence; identical to SEQ ID NO: 108024
  derived and/or modified sequence opt2 from neuraminidase__InfluenzaA__AHL90653

SEQ ID NO: 116151 - RNA, 1410 nt, Artificial Sequence; identical to SEQ ID NO: 108111
  derived and/or modified sequence opt2 from neuraminidase__InfluenzaA__AHL90665

SEQ ID NO: 116152 - RNA, 1410 nt, Artificial Sequence
  derived and/or modified sequence opt2 from neuraminidase__InfluenzaA__AHL90677
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116153 - RNA, 1410 nt, Artificial Sequence; identical to SEQ ID NO: 108111
  derived and/or modified sequence opt2 from neuraminidase__InfluenzaA__AHL90689

SEQ ID NO: 116154 - RNA, 1410 nt, Artificial Sequence
  derived and/or modified sequence opt2 from neuraminidase__InfluenzaA__AHL90701
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcggcaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116155 - RNA, 1410 nt, Artificial Sequence; identical to SEQ ID NO: 110816
  derived and/or modified sequence opt2 from neuraminidase__InfluenzaA__AHL90713

SEQ ID NO: 116156 - RNA, 1413 nt, Artificial Sequence; identical to SEQ ID NO: 111449
  derived and/or modified sequence opt2 from neuraminidase__InfluenzaA__AHL90725

SEQ ID NO: 116157 - RNA, 1413 nt, Artificial Sequence; identical to SEQ ID NO: 110442
  derived and/or modified sequence opt2 from neuraminidase__InfluenzaA__AHL90749

SEQ ID NO: 116158 - RNA, 1413 nt, Artificial Sequence; identical to SEQ ID NO: 108973
  derived and/or modified sequence opt2 from neuraminidase__InfluenzaA__AHL90761

SEQ ID NO: 116159 - RNA, 1413 nt, Artificial Sequence
  derived and/or modified sequence opt2 from neuraminidase__InfluenzaA__AHL90773
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggaccgcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116160 - RNA, 1413 nt, Artificial Sequence
  derived and/or modified sequence opt2 from neuraminidase__InfluenzaA__AHL90785
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaucaccaucuggaccuccggcuccuccaucuccuucugcggcgucaacuccgacaccgccaacugguccuggcccgacggcgccgagcuccccuucaccaucgacaaguga

SEQ ID NO: 116161 - RNA, 1413 nt, Artificial Sequence
  derived and/or modified sequence opt2 from neuraminidase__InfluenzaA__AHL90797
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaacaagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucgccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccgacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcucccccgucaccgucgacggcgccaacggcgucaagggcuucuccuacaaguacgacaacggcgucuggaucggccgcaccaaguccaaccgccuccgcaagggcuucgaggucaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116162 - RNA, 1413 nt, Artificial Sequence; identical to SEQ ID NO: 108973
  derived and/or modified sequence opt2 from neuraminidase__InfluenzaA__AHL90809

SEQ ID NO: 116163 - RNA, 1413 nt, Artificial Sequence; identical to SEQ ID NO: 111449
  derived and/or modified sequence opt2 from neuraminidase__InfluenzaA__AHL90821

SEQ ID NO: 116164 - RNA, 1413 nt, Artificial Sequence
  derived and/or modified sequence opt2 from neuraminidase__InfluenzaA__AHL90833
augaaccccaaccagcgcaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaugggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116165 - RNA, 1413 nt, Artificial Sequence; identical to SEQ ID NO: 108973
  derived and/or modified sequence opt2 from neuraminidase__InfluenzaA__AHL90845

SEQ ID NO: 116166 - RNA, 1413 nt, Artificial Sequence; identical to SEQ ID NO: 110442
  derived and/or modified sequence opt2 from neuraminidase__InfluenzaA__AHL90857

SEQ ID NO: 116167 - RNA, 1413 nt, Artificial Sequence; identical to SEQ ID NO: 108973
  derived and/or modified sequence opt2 from neuraminidase__InfluenzaA__AHL90869

SEQ ID NO: 116168 - RNA, 1413 nt, Artificial Sequence
  derived and/or modified sequence opt2 from neuraminidase__InfluenzaA__AHL90881
augaaccccaaccagaagaucaucaccaucggcuccaucuccaucgccaucggcaucaucuccaccaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccucaucaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116169 - RNA, 1413 nt, Artificial Sequence; identical to SEQ ID NO: 111449
  derived and/or modified sequence opt2 from neuraminidase__InfluenzaA__AHL90893

SEQ ID NO: 116170 - RNA, 1413 nt, Artificial Sequence; identical to SEQ ID NO: 110442
  derived and/or modified sequence opt2 from neuraminidase__InfluenzaA__AHL90905

SEQ ID NO: 116171 - RNA, 1413 nt, Artificial Sequence
  derived and/or modified sequence opt2 from neuraminidase__InfluenzaA__AHL90917
augaaccccaaccagaagaucaucaccaucggcuccaucuccaucgccaucggcaucaucucccucacccuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116172 - RNA, 1413 nt, Artificial Sequence
  derived and/or modified sequence opt2 from neuraminidase__InfluenzaA__AHL90929
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116173 - RNA, 1413 nt, Artificial Sequence; identical to SEQ ID NO: 110442
  derived and/or modified sequence opt2 from neuraminidase__InfluenzaA__AHL90941

SEQ ID NO: 116174 - RNA, 1413 nt, Artificial Sequence; identical to SEQ ID NO: 110442
  derived and/or modified sequence opt2 from neuraminidase__InfluenzaA__AHL90953

SEQ ID NO: 116175 - RNA, 1413 nt, Artificial Sequence; identical to SEQ ID NO: 110442
  derived and/or modified sequence opt2 from neuraminidase__InfluenzaA__AHL90965

SEQ ID NO: 116176 - RNA, 1413 nt, Artificial Sequence
  derived and/or modified sequence opt2 from neuraminidase__InfluenzaA__AHL90977
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucgccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116177 - RNA, 1413 nt, Artificial Sequence; identical to SEQ ID NO: 111716
  derived and/or modified sequence opt2 from neuraminidase__InfluenzaA__AHL90989

SEQ ID NO: 116178 - RNA, 1413 nt, Artificial Sequence; identical to SEQ ID NO: 116172
  derived and/or modified sequence opt2 from neuraminidase__InfluenzaA__AHL91001

SEQ ID NO: 116179 - RNA, 1413 nt, Artificial Sequence
  derived and/or modified sequence opt2 from neuraminidase__InfluenzaA__AHL91013
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcucccagcgcaucaucaccuacgagaacuccaccugggucaaccacaccuacgucaacaucaacaacaccaacgucgucgccggcgaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccauccgcuccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 116180 - RNA, 1413 nt, Artificial Sequence; identical to SEQ ID NO: 116172
  derived and/or modified sequence opt2 from neuraminidase__InfluenzaA__AHL91025

SEQ ID NO: 116181 - RNA, 1410 nt, Artificial Sequence; identical to SEQ ID NO: 109417
  derived and/or modified sequence opt2 from neuraminidase__InfluenzaA__AHL91037

SEQ ID NO: 116182 - RNA, 1410 nt, Artificial Sequence; identical to SEQ ID NO: 111030
  derived and/or modified sequence opt2 from neuraminidase__InfluenzaA__AHL91049

SEQ ID NO: 116183 - RNA, 1410 nt, Artificial Sequence
  derived and/or modified sequence opt2 from neuraminidase__InfluenzaA__AHL91061
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116184 - RNA, 1410 nt, Artificial Sequence
  derived and/or modified sequence opt2 from neuraminidase__InfluenzaA__AHL91073
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaccugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccggcucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116185 - RNA, 1410 nt, Artificial Sequence
  derived and/or modified sequence opt2 from neuraminidase__InfluenzaA__AHL91085
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaagaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaucugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 116186 - RNA, 1410 nt, Artificial Sequence; identical to SEQ ID NO: 108111
  derived and/or modified sequence opt2 from neuraminidase__InfluenzaA__AHL91097

SEQ ID NO: 116187 - RNA, 1410 nt, Artificial Sequence
  derived and/or modified sequence opt2 from neuraminidase__InfluenzaA__AHL91109
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaacaucaugcccaucuga

SEQ ID NO: 116188 - RNA, 1410 nt, Artificial Sequence; identical to SEQ ID NO: 109417
  derived and/or modified sequence opt2 from neuraminidase__InfluenzaA__AHL91121

SEQ ID NO: 116189 - RNA, 1410 nt, Artificial Sequence
  derived and/or modified sequence opt2 from neuraminidase__InfluenzaA__AHL91133
augaaccccaaccagaagaucaucaccaucggcuccgucucccucaccaucuccaccaucugcuucuucaugcagaucgccauccucaucaccaccgucacccuccacuucaagcaguucgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116190 - RNA, 1410 nt, Artificial Sequence; identical to SEQ ID NO: 110816
  derived and/or modified sequence opt2 from neuraminidase__InfluenzaA__AHL91145

SEQ ID NO: 116191 - RNA, 1410 nt, Artificial Sequence; identical to SEQ ID NO: 110816
  derived and/or modified sequence opt2 from neuraminidase__InfluenzaA__AHL91157

SEQ ID NO: 116192 - RNA, 1410 nt, Artificial Sequence; identical to SEQ ID NO: 106224
  derived and/or modified sequence opt2 from neuraminidase__InfluenzaA__AHL91169

SEQ ID NO: 116193 - RNA, 1410 nt, Artificial Sequence; identical to SEQ ID NO: 113658
  derived and/or modified sequence opt2 from neuraminidase__InfluenzaA__AHL94987

SEQ ID NO: 116194 - RNA, 1410 nt, Artificial Sequence; identical to SEQ ID NO: 113658
  derived and/or modified sequence opt2 from neuraminidase__InfluenzaA__AHL94999

SEQ ID NO: 116195 - RNA, 1410 nt, Artificial Sequence
  derived and/or modified sequence opt2 from neuraminidase__InfluenzaA__AHL95011
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguucaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116196 - RNA, 1410 nt, Artificial Sequence; identical to SEQ ID NO: 115415
  derived and/or modified sequence opt2 from neuraminidase__InfluenzaA__AHL95023

SEQ ID NO: 116197 - RNA, 1410 nt, Artificial Sequence; identical to SEQ ID NO: 113658
  derived and/or modified sequence opt2 from neuraminidase__InfluenzaA__AHL95035

SEQ ID NO: 116198 - RNA, 1410 nt, Artificial Sequence; identical to SEQ ID NO: 113658
  derived and/or modified sequence opt2 from neuraminidase__InfluenzaA__AHL95047

SEQ ID NO: 116199 - RNA, 1410 nt, Artificial Sequence; identical to SEQ ID NO: 115406
  derived and/or modified sequence opt2 from neuraminidase__InfluenzaA__AHL95059

SEQ ID NO: 116200 - RNA, 1410 nt, Artificial Sequence; identical to SEQ ID NO: 113658
  derived and/or modified sequence opt2 from neuraminidase__InfluenzaA__AHL95071

SEQ ID NO: 116201 - RNA, 1410 nt, Artificial Sequence; identical to SEQ ID NO: 113658
  derived and/or modified sequence opt2 from neuraminidase__InfluenzaA__AHL95083

SEQ ID NO: 116202 - RNA, 1410 nt, Artificial Sequence; identical to SEQ ID NO: 113658
  derived and/or modified sequence opt2 from neuraminidase__InfluenzaA__AHL95095

SEQ ID NO: 116203 - RNA, 1410 nt, Artificial Sequence; identical to SEQ ID NO: 113658
  derived and/or modified sequence opt2 from neuraminidase__InfluenzaA__AHL95107

SEQ ID NO: 116204 - RNA, 1410 nt, Artificial Sequence
  derived and/or modified sequence opt2 from neuraminidase__InfluenzaA__AHL95119
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacucccucuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116205 - RNA, 1410 nt, Artificial Sequence; identical to SEQ ID NO: 114887
  derived and/or modified sequence opt2 from neuraminidase__InfluenzaA__AHL95131

SEQ ID NO: 116206 - RNA, 1410 nt, Artificial Sequence; identical to SEQ ID NO: 115395
  derived and/or modified sequence opt2 from neuraminidase__InfluenzaA__AHL95143

SEQ ID NO: 116207 - RNA, 1410 nt, Artificial Sequence
  derived and/or modified sequence opt2 from neuraminidase__InfluenzaA__AHL95155
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcucccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116208 - RNA, 1410 nt, Artificial Sequence
  derived and/or modified sequence opt2 from neuraminidase__InfluenzaA__AHL95167
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116209 - RNA, 1410 nt, Artificial Sequence; identical to SEQ ID NO: 113658
  derived and/or modified sequence opt2 from neuraminidase__InfluenzaA__AHL95179

SEQ ID NO: 116210 - RNA, 1410 nt, Artificial Sequence; identical to SEQ ID NO: 113658
  derived and/or modified sequence opt2 from neuraminidase__InfluenzaA__AHL95191

SEQ ID NO: 116211 - RNA, 1410 nt, Artificial Sequence; identical to SEQ ID NO: 113658
  derived and/or modified sequence opt2 from neuraminidase__InfluenzaA__AHL95203

SEQ ID NO: 116212 - RNA, 1410 nt, Artificial Sequence; identical to SEQ ID NO: 113658
  derived and/or modified sequence opt2 from neuraminidase__InfluenzaA__AHL95215

SEQ ID NO: 116213 - RNA, 1410 nt, Artificial Sequence
  derived and/or modified sequence opt2 from neuraminidase__InfluenzaA__AHL95227
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcgagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116214 - RNA, 1410 nt, Artificial Sequence; identical to SEQ ID NO: 115395
  derived and/or modified sequence opt2 from neuraminidase__InfluenzaA__AHL95239

SEQ ID NO: 116215 - RNA, 1410 nt, Artificial Sequence
  derived and/or modified sequence opt2 from neuraminidase__InfluenzaA__AHL95251
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116216 - RNA, 1410 nt, Artificial Sequence; identical to SEQ ID NO: 113658
  derived and/or modified sequence opt2 from neuraminidase__InfluenzaA__AHL95263

SEQ ID NO: 116217 - RNA, 1410 nt, Artificial Sequence
  derived and/or modified sequence opt2 from neuraminidase__InfluenzaA__AHL95275
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaucaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116218 - RNA, 1410 nt, Artificial Sequence; identical to SEQ ID NO: 114901
  derived and/or modified sequence opt2 from neuraminidase__InfluenzaA__AHL95299

SEQ ID NO: 116219 - RNA, 1410 nt, Artificial Sequence
  derived and/or modified sequence opt2 from neuraminidase__InfluenzaA__AHL95310
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaaccucaaccucaugcccaucuga

SEQ ID NO: 116220 - RNA, 1410 nt, Artificial Sequence; identical to SEQ ID NO: 115406
  derived and/or modified sequence opt2 from neuraminidase__InfluenzaA__AHL95322

SEQ ID NO: 116221 - RNA, 1410 nt, Artificial Sequence; identical to SEQ ID NO: 115383
  derived and/or modified sequence opt2 from neuraminidase__InfluenzaA__AHL95334

SEQ ID NO: 116222 - RNA, 1410 nt, Artificial Sequence; identical to SEQ ID NO: 113658
  derived and/or modified sequence opt2 from neuraminidase__InfluenzaA__AHL95423

SEQ ID NO: 116223 - RNA, 1410 nt, Artificial Sequence; identical to SEQ ID NO: 115406
  derived and/or modified sequence opt2 from neuraminidase__InfluenzaA__AHL95435

SEQ ID NO: 116224 - RNA, 1410 nt, Artificial Sequence; identical to SEQ ID NO: 115383
  derived and/or modified sequence opt2 from neuraminidase__InfluenzaA__AHL95447

SEQ ID NO: 116225 - RNA, 1410 nt, Artificial Sequence
  derived and/or modified sequence opt2 from neuraminidase__InfluenzaA__AHL95461
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116226 - RNA, 1410 nt, Artificial Sequence; identical to SEQ ID NO: 114434
  derived and/or modified sequence opt2 from neuraminidase__InfluenzaA__AHL95473

SEQ ID NO: 116227 - RNA, 1410 nt, Artificial Sequence; identical to SEQ ID NO: 113658
  derived and/or modified sequence opt2 from neuraminidase__InfluenzaA__AHL95485

SEQ ID NO: 116228 - RNA, 1410 nt, Artificial Sequence; identical to SEQ ID NO: 113658
  derived and/or modified sequence opt2 from neuraminidase__InfluenzaA__AHL95497

SEQ ID NO: 116229 - RNA, 1410 nt, Artificial Sequence
  derived and/or modified sequence opt2 from neuraminidase__InfluenzaA__AHL95509
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116230 - RNA, 1410 nt, Artificial Sequence; identical to SEQ ID NO: 113658
  derived and/or modified sequence opt2 from neuraminidase__InfluenzaA__AHL95521

SEQ ID NO: 116231 - RNA, 1410 nt, Artificial Sequence; identical to SEQ ID NO: 113658
  derived and/or modified sequence opt2 from neuraminidase__InfluenzaA__AHL95533

SEQ ID NO: 116232 - RNA, 1410 nt, Artificial Sequence; identical to SEQ ID NO: 113658
  derived and/or modified sequence opt2 from neuraminidase__InfluenzaA__AHL95545

SEQ ID NO: 116233 - RNA, 1410 nt, Artificial Sequence
  derived and/or modified sequence opt2 from neuraminidase__InfluenzaA__AHL95557
augaaccccaaccagaagaucaucaccaucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccgaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116234 - RNA, 1410 nt, Artificial Sequence; identical to SEQ ID NO: 115383
  derived and/or modified sequence opt2 from neuraminidase__InfluenzaA__AHL95569

SEQ ID NO: 116235 - RNA, 1410 nt, Artificial Sequence; identical to SEQ ID NO: 113658
  derived and/or modified sequence opt2 from neuraminidase__InfluenzaA__AHL95581

SEQ ID NO: 116236 - RNA, 1410 nt, Artificial Sequence
  derived and/or modified sequence opt2 from neuraminidase__InfluenzaA__AHL95605
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacaucuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116237 - RNA, 1410 nt, Artificial Sequence; identical to SEQ ID NO: 113658
  derived and/or modified sequence opt2 from neuraminidase__InfluenzaA__AHL95617

SEQ ID NO: 116238 - RNA, 1410 nt, Artificial Sequence; identical to SEQ ID NO: 113658
  derived and/or modified sequence opt2 from neuraminidase__InfluenzaA__AHL95629

SEQ ID NO: 116239 - RNA, 1410 nt, Artificial Sequence; identical to SEQ ID NO: 113658
  derived and/or modified sequence opt2 from neuraminidase__InfluenzaA__AHL95641

SEQ ID NO: 116240 - RNA, 1410 nt, Artificial Sequence; identical to SEQ ID NO: 113658
  derived and/or modified sequence opt2 from neuraminidase__InfluenzaA__AHL95653

SEQ ID NO: 116241 - RNA, 1410 nt, Artificial Sequence; identical to SEQ ID NO: 116236
  derived and/or modified sequence opt2 from neuraminidase__InfluenzaA__AHL95665

SEQ ID NO: 116242 - RNA, 1410 nt, Artificial Sequence; identical to SEQ ID NO: 113658
  derived and/or modified sequence opt2 from neuraminidase__InfluenzaA__AHL95677

SEQ ID NO: 116243 - RNA, 1410 nt, Artificial Sequence
  derived and/or modified sequence opt2 from neuraminidase__InfluenzaA__AHL95689
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaaccucaaccucaugcccaucuga

SEQ ID NO: 116244 - RNA, 1410 nt, Artificial Sequence; identical to SEQ ID NO: 113658
  derived and/or modified sequence opt2 from neuraminidase__InfluenzaA__AHL95701

SEQ ID NO: 116245 - RNA, 1410 nt, Artificial Sequence; identical to SEQ ID NO: 113658
  derived and/or modified sequence opt2 from neuraminidase__InfluenzaA__AHL95713

SEQ ID NO: 116246 - RNA, 1410 nt, Artificial Sequence
  derived and/or modified sequence opt2 from neuraminidase__InfluenzaA__AHL95725
augaaccccaaccagaagaucaucaccaucggcuccgucucccucaccaucuccaccaucugcuucuucaugcagaucgccauccucaucaccaccgucacccuccacuucaagcaguacgaguucgaccccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaucgagguccucuggaccuccaacuccaucgucgucuucugcggcaccuccggcaccuacggcaccggcuccuggcccgacggcgccgaccucaaccucaugcccaucuga

SEQ ID NO: 116247 - RNA, 1410 nt, Artificial Sequence; identical to SEQ ID NO: 115395
  derived and/or modified sequence opt2 from neuraminidase__InfluenzaA__AHL95737

SEQ ID NO: 116248 - RNA, 1410 nt, Artificial Sequence
  derived and/or modified sequence opt2 from neuraminidase__InfluenzaA__AHL95749
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116249 - RNA, 1410 nt, Artificial Sequence; identical to SEQ ID NO: 113658
  derived and/or modified sequence opt2 from neuraminidase__InfluenzaA__AHL95761

SEQ ID NO: 116250 - RNA, 1410 nt, Artificial Sequence; identical to SEQ ID NO: 113658
  derived and/or modified sequence opt2 from neuraminidase__InfluenzaA__AHL95773

SEQ ID NO: 116251 - RNA, 1410 nt, Artificial Sequence
  derived and/or modified sequence opt2 from neuraminidase__InfluenzaA__AHL95785
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccguccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116252 - RNA, 1410 nt, Artificial Sequence; identical to SEQ ID NO: 115383
  derived and/or modified sequence opt2 from neuraminidase__InfluenzaA__AHL95797

SEQ ID NO: 116253 - RNA, 1410 nt, Artificial Sequence; identical to SEQ ID NO: 113658
  derived and/or modified sequence opt2 from neuraminidase__InfluenzaA__AHL95833

SEQ ID NO: 116254 - RNA, 1410 nt, Artificial Sequence; identical to SEQ ID NO: 115383
  derived and/or modified sequence opt2 from neuraminidase__InfluenzaA__AHL95845

SEQ ID NO: 116255 - RNA, 1410 nt, Artificial Sequence
  derived and/or modified sequence opt2 from neuraminidase__InfluenzaA__AHL95857
augaaccccaaccagaagaucaucuccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116256 - RNA, 1410 nt, Artificial Sequence; identical to SEQ ID NO: 113658
  derived and/or modified sequence opt2 from neuraminidase__InfluenzaA__AHL95869

SEQ ID NO: 116257 - RNA, 1410 nt, Artificial Sequence
  derived and/or modified sequence opt2 from neuraminidase__InfluenzaA__AHL95881
augaaccccaaccagaagaucaucaccaucggcuccgucugcaugaccaucggcauggccaaccucauccuccagaucggcaacaucaucuccaucuggaucucccacuccauccaggucggcaaccagucccagaucgagaccugcaaccaguccgucaucaccuacgagaacaacaccugggucaaccagaccuacgucaacaucuccaacaccaaccucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116258 - RNA, 1410 nt, Artificial Sequence
  derived and/or modified sequence opt2 from neuraminidase__InfluenzaA__AHL95892
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116259 - RNA, 1410 nt, Artificial Sequence; identical to SEQ ID NO: 113658
  derived and/or modified sequence opt2 from neuraminidase__InfluenzaA__AHL95904

SEQ ID NO: 116260 - RNA, 1410 nt, Artificial Sequence
  derived and/or modified sequence opt2 from neuraminidase__InfluenzaA__AHL95916
augaaccccaaccagaagaucaucaccaucggcuccgucucccucaccaucuccaccaucugcuucuucaugcagaucgccauccucaucaccaccgucacccuccacuucaagcaguacgagcucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116261 - RNA, 1410 nt, Artificial Sequence; identical to SEQ ID NO: 115395
  derived and/or modified sequence opt2 from neuraminidase__InfluenzaA__AHL95928

SEQ ID NO: 116262 - RNA, 1410 nt, Artificial Sequence; identical to SEQ ID NO: 115383
  derived and/or modified sequence opt2 from neuraminidase__InfluenzaA__AHL95940

SEQ ID NO: 116263 - RNA, 1410 nt, Artificial Sequence; identical to SEQ ID NO: 113658
  derived and/or modified sequence opt2 from neuraminidase__InfluenzaA__AHL95952

SEQ ID NO: 116264 - RNA, 1410 nt, Artificial Sequence; identical to SEQ ID NO: 113658
  derived and/or modified sequence opt2 from neuraminidase__InfluenzaA__AHL95964

SEQ ID NO: 116265 - RNA, 1410 nt, Artificial Sequence; identical to SEQ ID NO: 113658
  derived and/or modified sequence opt2 from neuraminidase__InfluenzaA__AHL95976

SEQ ID NO: 116266 - RNA, 1410 nt, Artificial Sequence; identical to SEQ ID NO: 113658
  derived and/or modified sequence opt2 from neuraminidase__InfluenzaA__AHL95988

SEQ ID NO: 116267 - RNA, 1410 nt, Artificial Sequence; identical to SEQ ID NO: 113658
  derived and/or modified sequence opt2 from neuraminidase__InfluenzaA__AHL96000

SEQ ID NO: 116268 - RNA, 1410 nt, Artificial Sequence
  derived and/or modified sequence opt2 from neuraminidase__InfluenzaA__AHL96012
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcguccccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116269 - RNA, 1410 nt, Artificial Sequence
  derived and/or modified sequence opt2 from neuraminidase__InfluenzaA__AHL96024
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagaaccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116270 - RNA, 1410 nt, Artificial Sequence; identical to SEQ ID NO: 113658
  derived and/or modified sequence opt2 from neuraminidase__InfluenzaA__AHL96036

SEQ ID NO: 116271 - RNA, 1410 nt, Artificial Sequence; identical to SEQ ID NO: 114901
  derived and/or modified sequence opt2 from neuraminidase__InfluenzaA__AHL96048

SEQ ID NO: 116272 - RNA, 1410 nt, Artificial Sequence; identical to SEQ ID NO: 113658
  derived and/or modified sequence opt2 from neuraminidase__InfluenzaA__AHL96059

SEQ ID NO: 116273 - RNA, 1410 nt, Artificial Sequence; identical to SEQ ID NO: 115395
  derived and/or modified sequence opt2 from neuraminidase__InfluenzaA__AHL96071

SEQ ID NO: 116274 - RNA, 1410 nt, Artificial Sequence; identical to SEQ ID NO: 116236
  derived and/or modified sequence opt2 from neuraminidase__InfluenzaA__AHL96083

SEQ ID NO: 116275 - RNA, 1410 nt, Artificial Sequence; identical to SEQ ID NO: 113658
  derived and/or modified sequence opt2 from neuraminidase__InfluenzaA__AHL96095

SEQ ID NO: 116276 - RNA, 1410 nt, Artificial Sequence
  derived and/or modified sequence opt2 from neuraminidase__InfluenzaA__AHL96107
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacaacuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116277 - RNA, 1410 nt, Artificial Sequence; identical to SEQ ID NO: 113658
  derived and/or modified sequence opt2 from neuraminidase__InfluenzaA__AHL96119

SEQ ID NO: 116278 - RNA, 1410 nt, Artificial Sequence; identical to SEQ ID NO: 115395
  derived and/or modified sequence opt2 from neuraminidase__InfluenzaA__AHL96131

SEQ ID NO: 116279 - RNA, 1410 nt, Artificial Sequence; identical to SEQ ID NO: 113658
  derived and/or modified sequence opt2 from neuraminidase__InfluenzaA__AHL96143

SEQ ID NO: 116280 - RNA, 1410 nt, Artificial Sequence; identical to SEQ ID NO: 113658
  derived and/or modified sequence opt2 from neuraminidase__InfluenzaA__AHL96167

SEQ ID NO: 116281 - RNA, 1410 nt, Artificial Sequence; identical to SEQ ID NO: 113658
  derived and/or modified sequence opt2 from neuraminidase__InfluenzaA__AHL96179

SEQ ID NO: 116282 - RNA, 1410 nt, Artificial Sequence
  derived and/or modified sequence opt2 from neuraminidase__InfluenzaA__AHL96191
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116283 - RNA, 1410 nt, Artificial Sequence; identical to SEQ ID NO: 115383
  derived and/or modified sequence opt2 from neuraminidase__InfluenzaA__AHL96203

SEQ ID NO: 116284 - RNA, 1410 nt, Artificial Sequence; identical to SEQ ID NO: 115395
  derived and/or modified sequence opt2 from neuraminidase__InfluenzaA__AHL96215

SEQ ID NO: 116285 - RNA, 1410 nt, Artificial Sequence; identical to SEQ ID NO: 113658
  derived and/or modified sequence opt2 from neuraminidase__InfluenzaA__AHL96227

SEQ ID NO: 116286 - RNA, 1410 nt, Artificial Sequence; identical to SEQ ID NO: 113658
  derived and/or modified sequence opt2 from neuraminidase__InfluenzaA__AHL96239

SEQ ID NO: 116287 - RNA, 1410 nt, Artificial Sequence; identical to SEQ ID NO: 113658
  derived and/or modified sequence opt2 from neuraminidase__InfluenzaA__AHL96251

SEQ ID NO: 116288 - RNA, 1410 nt, Artificial Sequence; identical to SEQ ID NO: 113658
  derived and/or modified sequence opt2 from neuraminidase__InfluenzaA__AHL96263

SEQ ID NO: 116289 - RNA, 1410 nt, Artificial Sequence; identical to SEQ ID NO: 115439
  derived and/or modified sequence opt2 from neuraminidase__InfluenzaA__AHL96277

SEQ ID NO: 116290 - RNA, 1410 nt, Artificial Sequence
  derived and/or modified sequence opt2 from neuraminidase__InfluenzaA__AHL96308
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucauguccgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116291 - RNA, 1410 nt, Artificial Sequence; identical to SEQ ID NO: 114887
  derived and/or modified sequence opt2 from neuraminidase__InfluenzaA__AHL96321

SEQ ID NO: 116292 - RNA, 1410 nt, Artificial Sequence; identical to SEQ ID NO: 113658
  derived and/or modified sequence opt2 from neuraminidase__InfluenzaA__AHL96333

SEQ ID NO: 116293 - RNA, 1410 nt, Artificial Sequence
  derived and/or modified sequence opt2 from neuraminidase__InfluenzaA__AHL96345
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacaacuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116294 - RNA, 1410 nt, Artificial Sequence; identical to SEQ ID NO: 115383
  derived and/or modified sequence opt2 from neuraminidase__InfluenzaA__AHL96357

SEQ ID NO: 116295 - RNA, 1410 nt, Artificial Sequence; identical to SEQ ID NO: 113658
  derived and/or modified sequence opt2 from neuraminidase__InfluenzaA__AHL96369

SEQ ID NO: 116296 - RNA, 1410 nt, Artificial Sequence; identical to SEQ ID NO: 113658
  derived and/or modified sequence opt2 from neuraminidase__InfluenzaA__AHL96381

SEQ ID NO: 116297 - RNA, 1410 nt, Artificial Sequence; identical to SEQ ID NO: 115395
  derived and/or modified sequence opt2 from neuraminidase__InfluenzaA__AHL96393

SEQ ID NO: 116298 - RNA, 1410 nt, Artificial Sequence
  derived and/or modified sequence opt2 from neuraminidase__InfluenzaA__AHL96405
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucggccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116299 - RNA, 1410 nt, Artificial Sequence; identical to SEQ ID NO: 113658
  derived and/or modified sequence opt2 from neuraminidase__InfluenzaA__AHL96417

SEQ ID NO: 116300 - RNA, 1410 nt, Artificial Sequence; identical to SEQ ID NO: 113658
  derived and/or modified sequence opt2 from neuraminidase__InfluenzaA__AHL96429

SEQ ID NO: 116301 - RNA, 1410 nt, Artificial Sequence
  derived and/or modified sequence opt2 from neuraminidase__InfluenzaA__AHL96441
augaaccccaaccagaagaucaucaccaucggcuccgucucccucaccaucuccaccaucugcuucuucaugcagaucgccauccucaucaccaccgucacccuccacuucaagcacuacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccagaucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116302 - RNA, 1410 nt, Artificial Sequence; identical to SEQ ID NO: 113658
  derived and/or modified sequence opt2 from neuraminidase__InfluenzaA__AHL96453

SEQ ID NO: 116303 - RNA, 1410 nt, Artificial Sequence; identical to SEQ ID NO: 113658
  derived and/or modified sequence opt2 from neuraminidase__InfluenzaA__AHL96465

SEQ ID NO: 116304 - RNA, 1410 nt, Artificial Sequence
  derived and/or modified sequence opt2 from neuraminidase__InfluenzaA__AHL96477
augaaccccaaccagaagaucaucaccaucggcuccgucugcaugaccaucggcauggccaaccucauccuccagaucggcaacaucaucuccaucuggaucucccacuccauccaggucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116305 - RNA, 1410 nt, Artificial Sequence; identical to SEQ ID NO: 115395
  derived and/or modified sequence opt2 from neuraminidase__InfluenzaA__AHL96488

SEQ ID NO: 116306 - RNA, 1410 nt, Artificial Sequence; identical to SEQ ID NO: 113658
  derived and/or modified sequence opt2 from neuraminidase__InfluenzaA__AHL96500

SEQ ID NO: 116307 - RNA, 1410 nt, Artificial Sequence; identical to SEQ ID NO: 113658
  derived and/or modified sequence opt2 from neuraminidase__InfluenzaA__AHL96512

SEQ ID NO: 116308 - RNA, 1410 nt, Artificial Sequence; identical to SEQ ID NO: 114887
  derived and/or modified sequence opt2 from neuraminidase__InfluenzaA__AHL96524

SEQ ID NO: 116309 - RNA, 1410 nt, Artificial Sequence
  derived and/or modified sequence opt2 from neuraminidase__InfluenzaA__AHL96536
augaaccccaaccagaagaucaucaccaucggcuccgucucccucaccaucuccaccaucugcuucuucacccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccaccaucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116310 - RNA, 1410 nt, Artificial Sequence; identical to SEQ ID NO: 115395
  derived and/or modified sequence opt2 from neuraminidase__InfluenzaA__AHL96548

SEQ ID NO: 116311 - RNA, 1410 nt, Artificial Sequence
  derived and/or modified sequence opt2 from neuraminidase__InfluenzaA__AHL96560
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcaacgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116312 - RNA, 1410 nt, Artificial Sequence; identical to SEQ ID NO: 114869
  derived and/or modified sequence opt2 from neuraminidase__InfluenzaA__AHL96572

SEQ ID NO: 116313 - RNA, 1410 nt, Artificial Sequence; identical to SEQ ID NO: 116304
  derived and/or modified sequence opt2 from neuraminidase__InfluenzaA__AHL96584

SEQ ID NO: 116314 - RNA, 1410 nt, Artificial Sequence
  derived and/or modified sequence opt2 from neuraminidase__InfluenzaA__AHL96595
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgaguccaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116315 - RNA, 1410 nt, Artificial Sequence; identical to SEQ ID NO: 113658
  derived and/or modified sequence opt2 from neuraminidase__InfluenzaA__AHL96607

SEQ ID NO: 116316 - RNA, 1410 nt, Artificial Sequence
  derived and/or modified sequence opt2 from neuraminidase__InfluenzaA__AHL96631
augaaccccaaccagaagaucaucaccaucggcuccgucucccucaccaucuccaccaucugcuucuucaugcagaucgccauccucaucaccaccgucacccuccacuucaagcaguacgaguucaacucccuccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116317 - RNA, 1410 nt, Artificial Sequence; identical to SEQ ID NO: 115395
  derived and/or modified sequence opt2 from neuraminidase__InfluenzaA__AHL96643

SEQ ID NO: 116318 - RNA, 1410 nt, Artificial Sequence; identical to SEQ ID NO: 113658
  derived and/or modified sequence opt2 from neuraminidase__InfluenzaA__AHL96655

SEQ ID NO: 116319 - RNA, 1410 nt, Artificial Sequence; identical to SEQ ID NO: 113658
  derived and/or modified sequence opt2 from neuraminidase__InfluenzaA__AHL96667

SEQ ID NO: 116320 - RNA, 1410 nt, Artificial Sequence; identical to SEQ ID NO: 113658
  derived and/or modified sequence opt2 from neuraminidase__InfluenzaA__AHL96679

SEQ ID NO: 116321 - RNA, 1410 nt, Artificial Sequence; identical to SEQ ID NO: 113658
  derived and/or modified sequence opt2 from neuraminidase__InfluenzaA__AHL96691

SEQ ID NO: 116322 - RNA, 1410 nt, Artificial Sequence; identical to SEQ ID NO: 113658
  derived and/or modified sequence opt2 from neuraminidase__InfluenzaA__AHL96703

SEQ ID NO: 116323 - RNA, 1410 nt, Artificial Sequence; identical to SEQ ID NO: 115383
  derived and/or modified sequence opt2 from neuraminidase__InfluenzaA__AHL96763

SEQ ID NO: 116324 - RNA, 1410 nt, Artificial Sequence; identical to SEQ ID NO: 116236
  derived and/or modified sequence opt2 from neuraminidase__InfluenzaA__AHL96787

SEQ ID NO: 116325 - RNA, 1410 nt, Artificial Sequence
  derived and/or modified sequence opt2 from neuraminidase__InfluenzaA__AHL96799
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggacgagaccgagguccucuggaccuccaacuccaucgucgucuucugcggcaccuccggcaccuacggcaccggcuccuggcccgacggcgccgaccucaaccucaugcccaucuga

SEQ ID NO: 116326 - RNA, 1410 nt, Artificial Sequence; identical to SEQ ID NO: 115395
  derived and/or modified sequence opt2 from neuraminidase__InfluenzaA__AHL96811

SEQ ID NO: 116327 - RNA, 1410 nt, Artificial Sequence; identical to SEQ ID NO: 115395
  derived and/or modified sequence opt2 from neuraminidase__InfluenzaA__AHL96823

SEQ ID NO: 116328 - RNA, 1410 nt, Artificial Sequence; identical to SEQ ID NO: 113658
  derived and/or modified sequence opt2 from neuraminidase__InfluenzaA__AHL96847

SEQ ID NO: 116329 - RNA, 1410 nt, Artificial Sequence
  derived and/or modified sequence opt2 from neuraminidase__InfluenzaA__AHL96859
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116330 - RNA, 1410 nt, Artificial Sequence
  derived and/or modified sequence opt2 from neuraminidase__InfluenzaA__AHL96871
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucgucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagguccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgaccgcuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116331 - RNA, 1410 nt, Artificial Sequence
  derived and/or modified sequence opt2 from neuraminidase__InfluenzaA__AHL96883
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaaguccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116332 - RNA, 1410 nt, Artificial Sequence; identical to SEQ ID NO: 115383
  derived and/or modified sequence opt2 from neuraminidase__InfluenzaA__AHL96895

SEQ ID NO: 116333 - RNA, 1410 nt, Artificial Sequence
  derived and/or modified sequence opt2 from neuraminidase__InfluenzaA__AHL96907
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucgucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagguccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116334 - RNA, 1410 nt, Artificial Sequence; identical to SEQ ID NO: 115395
  derived and/or modified sequence opt2 from neuraminidase__InfluenzaA__AHL96919

SEQ ID NO: 116335 - RNA, 1410 nt, Artificial Sequence; identical to SEQ ID NO: 115395
  derived and/or modified sequence opt2 from neuraminidase__InfluenzaA__AHL96931

SEQ ID NO: 116336 - RNA, 1410 nt, Artificial Sequence; identical to SEQ ID NO: 115395
  derived and/or modified sequence opt2 from neuraminidase__InfluenzaA__AHL96943

SEQ ID NO: 116337 - RNA, 1410 nt, Artificial Sequence
  derived and/or modified sequence opt2 from neuraminidase__InfluenzaA__AHL96955
augaaccccaaccagaagaucaucaccaucggcuccgucucccucaccaucuccaccaucugcuucuucaugcagaucgccauccucaucaccaccgucacccuccacuucaagcaguacgaguucaacucccccuccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcaacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116338 - RNA, 1410 nt, Artificial Sequence; identical to SEQ ID NO: 116236
  derived and/or modified sequence opt2 from neuraminidase__InfluenzaA__AHL96967

SEQ ID NO: 116339 - RNA, 1410 nt, Artificial Sequence
  derived and/or modified sequence opt2 from neuraminidase__InfluenzaA__AHL96979
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaacaucaugcccaucuga

SEQ ID NO: 116340 - RNA, 1410 nt, Artificial Sequence; identical to SEQ ID NO: 115395
  derived and/or modified sequence opt2 from neuraminidase__InfluenzaA__AHL96991

SEQ ID NO: 116341 - RNA, 1410 nt, Artificial Sequence; identical to SEQ ID NO: 113658
  derived and/or modified sequence opt2 from neuraminidase__InfluenzaA__AHL97003

SEQ ID NO: 116342 - RNA, 1410 nt, Artificial Sequence
  derived and/or modified sequence opt2 from neuraminidase__InfluenzaA__AHL97015
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccagaucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116343 - RNA, 1410 nt, Artificial Sequence; identical to SEQ ID NO: 113658
  derived and/or modified sequence opt2 from neuraminidase__InfluenzaA__AHL97027

SEQ ID NO: 116344 - RNA, 1410 nt, Artificial Sequence
  derived and/or modified sequence opt2 from neuraminidase__InfluenzaA__AHL97039
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcaacgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116345 - RNA, 1410 nt, Artificial Sequence; identical to SEQ ID NO: 113658
  derived and/or modified sequence opt2 from neuraminidase__InfluenzaA__AHL97051

SEQ ID NO: 116346 - RNA, 1410 nt, Artificial Sequence
  derived and/or modified sequence opt2 from neuraminidase__InfluenzaA__AHL97063
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucggccccaacaacgaggagggcggccacggcgucaagggcugggccuucgacgacggcaacgacgucuggaugggccgcaccaucaacgagaccucccgccucggcuacgagaccuucaaggucaucgacggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116347 - RNA, 1410 nt, Artificial Sequence; identical to SEQ ID NO: 113658
  derived and/or modified sequence opt2 from neuraminidase__InfluenzaA__AHL97075

SEQ ID NO: 116348 - RNA, 1410 nt, Artificial Sequence; identical to SEQ ID NO: 115383
  derived and/or modified sequence opt2 from neuraminidase__InfluenzaA__AHL97087

SEQ ID NO: 116349 - RNA, 1410 nt, Artificial Sequence; identical to SEQ ID NO: 114887
  derived and/or modified sequence opt2 from neuraminidase__InfluenzaA__AHL97099

SEQ ID NO: 116350 - RNA, 1410 nt, Artificial Sequence; identical to SEQ ID NO: 113658
  derived and/or modified sequence opt2 from neuraminidase__InfluenzaA__AHL97111

SEQ ID NO: 116351 - RNA, 1410 nt, Artificial Sequence
  derived and/or modified sequence opt2 from neuraminidase__InfluenzaA__AHL97123
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgccgcaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116352 - RNA, 1410 nt, Artificial Sequence; identical to SEQ ID NO: 115415
  derived and/or modified sequence opt2 from neuraminidase__InfluenzaA__AHL97135

SEQ ID NO: 116353 - RNA, 1410 nt, Artificial Sequence
  derived and/or modified sequence opt2 from neuraminidase__InfluenzaA__AHL97147
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116354 - RNA, 1410 nt, Artificial Sequence; identical to SEQ ID NO: 113658
  derived and/or modified sequence opt2 from neuraminidase__InfluenzaA__AHL97159

SEQ ID NO: 116355 - RNA, 1410 nt, Artificial Sequence; identical to SEQ ID NO: 113658
  derived and/or modified sequence opt2 from neuraminidase__InfluenzaA__AHL97171

SEQ ID NO: 116356 - RNA, 1410 nt, Artificial Sequence; identical to SEQ ID NO: 113658
  derived and/or modified sequence opt2 from neuraminidase__InfluenzaA__AHL97183

SEQ ID NO: 116357 - RNA, 1410 nt, Artificial Sequence; identical to SEQ ID NO: 113658
  derived and/or modified sequence opt2 from neuraminidase__InfluenzaA__AHL97195

SEQ ID NO: 116358 - RNA, 1410 nt, Artificial Sequence; identical to SEQ ID NO: 113658
  derived and/or modified sequence opt2 from neuraminidase__InfluenzaA__AHL97207

SEQ ID NO: 116359 - RNA, 1410 nt, Artificial Sequence; identical to SEQ ID NO: 113658
  derived and/or modified sequence opt2 from neuraminidase__InfluenzaA__AHL97219

SEQ ID NO: 116360 - RNA, 1410 nt, Artificial Sequence
  derived and/or modified sequence opt2 from neuraminidase__InfluenzaA__AHL97231
augaaccccaaccagaagaucaucaccaucggcuccgucucccucaccaucuccaccaucugcuucuucaugcagaucgccauccucaucaccaccgucacccuccacuucaagcaguacgacuucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccgucaucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucggcggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116361 - RNA, 1410 nt, Artificial Sequence
  derived and/or modified sequence opt2 from neuraminidase__InfluenzaA__AHL97243
augaaccccaaccagaagaucaucaccaucggcuccgucucccucaccaucuccaccaucugcuucuucaugcagaucgccauccucaucaccaccgucacccucaacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116362 - RNA, 1410 nt, Artificial Sequence; identical to SEQ ID NO: 114887
  derived and/or modified sequence opt2 from neuraminidase__InfluenzaA__AHL97255

SEQ ID NO: 116363 - RNA, 1410 nt, Artificial Sequence
  derived and/or modified sequence opt2 from neuraminidase__InfluenzaA__AHL97267
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116364 - RNA, 1410 nt, Artificial Sequence; identical to SEQ ID NO: 113658
  derived and/or modified sequence opt2 from neuraminidase__InfluenzaA__AHL97279

SEQ ID NO: 116365 - RNA, 1410 nt, Artificial Sequence; identical to SEQ ID NO: 116248
  derived and/or modified sequence opt2 from neuraminidase__InfluenzaA__AHL97291

SEQ ID NO: 116366 - RNA, 1410 nt, Artificial Sequence; identical to SEQ ID NO: 116236
  derived and/or modified sequence opt2 from neuraminidase__InfluenzaA__AHL97303

SEQ ID NO: 116367 - RNA, 1410 nt, Artificial Sequence
  derived and/or modified sequence opt2 from neuraminidase__InfluenzaA__AHL97339
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcaccuccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggccgcgccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116368 - RNA, 1410 nt, Artificial Sequence; identical to SEQ ID NO: 115383
  derived and/or modified sequence opt2 from neuraminidase__InfluenzaA__AHL97351

SEQ ID NO: 116369 - RNA, 1410 nt, Artificial Sequence; identical to SEQ ID NO: 116248
  derived and/or modified sequence opt2 from neuraminidase__InfluenzaA__AHL97363

SEQ ID NO: 116370 - RNA, 1410 nt, Artificial Sequence; identical to SEQ ID NO: 113658
  derived and/or modified sequence opt2 from neuraminidase__InfluenzaA__AHL97387

SEQ ID NO: 116371 - RNA, 1410 nt, Artificial Sequence
  derived and/or modified sequence opt2 from neuraminidase__InfluenzaA__AHL97399
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucauguaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggccgcuccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116372 - RNA, 1410 nt, Artificial Sequence; identical to SEQ ID NO: 114887
  derived and/or modified sequence opt2 from neuraminidase__InfluenzaA__AHL97411

SEQ ID NO: 116373 - RNA, 1410 nt, Artificial Sequence
  derived and/or modified sequence opt2 from neuraminidase__InfluenzaA__AHL97423
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacauguggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116374 - RNA, 1410 nt, Artificial Sequence
  derived and/or modified sequence opt2 from neuraminidase__InfluenzaA__AHL97447
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116375 - RNA, 1410 nt, Artificial Sequence; identical to SEQ ID NO: 113658
  derived and/or modified sequence opt2 from neuraminidase__InfluenzaA__AHL97459

SEQ ID NO: 116376 - RNA, 1410 nt, Artificial Sequence; identical to SEQ ID NO: 116248
  derived and/or modified sequence opt2 from neuraminidase__InfluenzaA__AHL97471

SEQ ID NO: 116377 - RNA, 1410 nt, Artificial Sequence; identical to SEQ ID NO: 115383
  derived and/or modified sequence opt2 from neuraminidase__InfluenzaA__AHL97483

SEQ ID NO: 116378 - RNA, 1410 nt, Artificial Sequence; identical to SEQ ID NO: 113658
  derived and/or modified sequence opt2 from neuraminidase__InfluenzaA__AHL97496

SEQ ID NO: 116379 - RNA, 1410 nt, Artificial Sequence; identical to SEQ ID NO: 113658
  derived and/or modified sequence opt2 from neuraminidase__InfluenzaA__AHL97508

SEQ ID NO: 116380 - RNA, 1410 nt, Artificial Sequence
  derived and/or modified sequence opt2 from neuraminidase__InfluenzaA__AHL97520
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaccugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116381 - RNA, 1410 nt, Artificial Sequence; identical to SEQ ID NO: 113658
  derived and/or modified sequence opt2 from neuraminidase__InfluenzaA__AHL97532

SEQ ID NO: 116382 - RNA, 1410 nt, Artificial Sequence; identical to SEQ ID NO: 113658
  derived and/or modified sequence opt2 from neuraminidase__InfluenzaA__AHL97544

SEQ ID NO: 116383 - RNA, 1410 nt, Artificial Sequence; identical to SEQ ID NO: 115383
  derived and/or modified sequence opt2 from neuraminidase__InfluenzaA__AHL97556

SEQ ID NO: 116384 - RNA, 1410 nt, Artificial Sequence
  derived and/or modified sequence opt2 from neuraminidase__InfluenzaA__AHL97568
augaaccccaaccagaagaucaucaccaucggcuccgucucccucaccaucuccgccaucugcuucuucaugcagaucgccauccucaucaccaccgucacccuccgcuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaccaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116385 - RNA, 1410 nt, Artificial Sequence; identical to SEQ ID NO: 116298
  derived and/or modified sequence opt2 from neuraminidase__InfluenzaA__AHL97580

SEQ ID NO: 116386 - RNA, 1410 nt, Artificial Sequence
  derived and/or modified sequence opt2 from neuraminidase__InfluenzaA__AHL97592
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccguccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucggccccaacaacgaggagggcggccacggcgucaagggcugggccuucgacgacggcaacgacgucuggaugggccgcaccaucaacgagaccucccgcuccggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116387 - RNA, 1410 nt, Artificial Sequence; identical to SEQ ID NO: 113658
  derived and/or modified sequence opt2 from neuraminidase__InfluenzaA__AHL97604

SEQ ID NO: 116388 - RNA, 1410 nt, Artificial Sequence
  derived and/or modified sequence opt2 from neuraminidase__InfluenzaA__AHL97616
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagguccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116389 - RNA, 1410 nt, Artificial Sequence; identical to SEQ ID NO: 116248
  derived and/or modified sequence opt2 from neuraminidase__InfluenzaA__AHL97628

SEQ ID NO: 116390 - RNA, 1410 nt, Artificial Sequence; identical to SEQ ID NO: 113658
  derived and/or modified sequence opt2 from neuraminidase__InfluenzaA__AHL97640

SEQ ID NO: 116391 - RNA, 1410 nt, Artificial Sequence; identical to SEQ ID NO: 115406
  derived and/or modified sequence opt2 from neuraminidase__InfluenzaA__AHL97652

SEQ ID NO: 116392 - RNA, 1410 nt, Artificial Sequence; identical to SEQ ID NO: 115406
  derived and/or modified sequence opt2 from neuraminidase__InfluenzaA__AHL97664

SEQ ID NO: 116393 - RNA, 1410 nt, Artificial Sequence; identical to SEQ ID NO: 114887
  derived and/or modified sequence opt2 from neuraminidase__InfluenzaA__AHL97676

SEQ ID NO: 116394 - RNA, 1410 nt, Artificial Sequence; identical to SEQ ID NO: 113658
  derived and/or modified sequence opt2 from neuraminidase__InfluenzaA__AHL97688

SEQ ID NO: 116395 - RNA, 1410 nt, Artificial Sequence; identical to SEQ ID NO: 115383
  derived and/or modified sequence opt2 from neuraminidase__InfluenzaA__AHL97700

SEQ ID NO: 116396 - RNA, 1410 nt, Artificial Sequence
  derived and/or modified sequence opt2 from neuraminidase__InfluenzaA__AHL97712
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccaccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116397 - RNA, 1410 nt, Artificial Sequence; identical to SEQ ID NO: 115383
  derived and/or modified sequence opt2 from neuraminidase__InfluenzaA__AHL97724

SEQ ID NO: 116398 - RNA, 1410 nt, Artificial Sequence; identical to SEQ ID NO: 113658
  derived and/or modified sequence opt2 from neuraminidase__InfluenzaA__AHL97736

SEQ ID NO: 116399 - RNA, 1410 nt, Artificial Sequence
  derived and/or modified sequence opt2 from neuraminidase__InfluenzaA__AHL97760
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacgagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116400 - RNA, 1410 nt, Artificial Sequence
  derived and/or modified sequence opt2 from neuraminidase__InfluenzaA__AHL97772
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccgucgucgucuucugcggcaccuccggcaccuacggcaccggcuccuggcccgacggcgccgaccucaaccucaugcccaucuga

SEQ ID NO: 116401 - RNA, 1410 nt, Artificial Sequence; identical to SEQ ID NO: 114887
  derived and/or modified sequence opt2 from neuraminidase__InfluenzaA__AHL97784

SEQ ID NO: 116402 - RNA, 1410 nt, Artificial Sequence; identical to SEQ ID NO: 113658
  derived and/or modified sequence opt2 from neuraminidase__InfluenzaA__AHL97796

SEQ ID NO: 116403 - RNA, 1410 nt, Artificial Sequence; identical to SEQ ID NO: 113658
  derived and/or modified sequence opt2 from neuraminidase__InfluenzaA__AHL97808

SEQ ID NO: 116404 - RNA, 1410 nt, Artificial Sequence; identical to SEQ ID NO: 113658
  derived and/or modified sequence opt2 from neuraminidase__InfluenzaA__AHL97820

SEQ ID NO: 116405 - RNA, 1410 nt, Artificial Sequence
  derived and/or modified sequence opt2 from neuraminidase__InfluenzaA__AHL97832
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcuccugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116406 - RNA, 1410 nt, Artificial Sequence; identical to SEQ ID NO: 113658
  derived and/or modified sequence opt2 from neuraminidase__InfluenzaA__AHL97844

SEQ ID NO: 116407 - RNA, 1410 nt, Artificial Sequence; identical to SEQ ID NO: 116399
  derived and/or modified sequence opt2 from neuraminidase__InfluenzaA__AHL97856

SEQ ID NO: 116408 - RNA, 1410 nt, Artificial Sequence; identical to SEQ ID NO: 113658
  derived and/or modified sequence opt2 from neuraminidase__InfluenzaA__AHL97868

SEQ ID NO: 116409 - RNA, 1410 nt, Artificial Sequence; identical to SEQ ID NO: 115383
  derived and/or modified sequence opt2 from neuraminidase__InfluenzaA__AHL97880

SEQ ID NO: 116410 - RNA, 1410 nt, Artificial Sequence; identical to SEQ ID NO: 113658
  derived and/or modified sequence opt2 from neuraminidase__InfluenzaA__AHL97892

SEQ ID NO: 116411 - RNA, 1410 nt, Artificial Sequence; identical to SEQ ID NO: 113658
  derived and/or modified sequence opt2 from neuraminidase__InfluenzaA__AHL97904

SEQ ID NO: 116412 - RNA, 1410 nt, Artificial Sequence; identical to SEQ ID NO: 115395
  derived and/or modified sequence opt2 from neuraminidase__InfluenzaA__AHL97916

SEQ ID NO: 116413 - RNA, 1410 nt, Artificial Sequence; identical to SEQ ID NO: 113658
  derived and/or modified sequence opt2 from neuraminidase__InfluenzaA__AHL97928

SEQ ID NO: 116414 - RNA, 1410 nt, Artificial Sequence; identical to SEQ ID NO: 116374
  derived and/or modified sequence opt2 from neuraminidase__InfluenzaA__AHL97952

SEQ ID NO: 116415 - RNA, 1410 nt, Artificial Sequence; identical to SEQ ID NO: 113658
  derived and/or modified sequence opt2 from neuraminidase__InfluenzaA__AHL97964

SEQ ID NO: 116416 - RNA, 1410 nt, Artificial Sequence; identical to SEQ ID NO: 113658
  derived and/or modified sequence opt2 from neuraminidase__InfluenzaA__AHL97976

SEQ ID NO: 116417 - RNA, 1410 nt, Artificial Sequence; identical to SEQ ID NO: 113658
  derived and/or modified sequence opt2 from neuraminidase__InfluenzaA__AHL97988

SEQ ID NO: 116418 - RNA, 1410 nt, Artificial Sequence
  derived and/or modified sequence opt2 from neuraminidase__InfluenzaA__AHL98000
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccacgaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaaggacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116419 - RNA, 1410 nt, Artificial Sequence
  derived and/or modified sequence opt2 from neuraminidase__InfluenzaA__AHL98012
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagguccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116420 - RNA, 1410 nt, Artificial Sequence; identical to SEQ ID NO: 115395
  derived and/or modified sequence opt2 from neuraminidase__InfluenzaA__AHL98048

SEQ ID NO: 116421 - RNA, 1410 nt, Artificial Sequence; identical to SEQ ID NO: 115395
  derived and/or modified sequence opt2 from neuraminidase__InfluenzaA__AHL98060

SEQ ID NO: 116422 - RNA, 1410 nt, Artificial Sequence; identical to SEQ ID NO: 115395
  derived and/or modified sequence opt2 from neuraminidase__InfluenzaA__AHL98072

SEQ ID NO: 116423 - RNA, 1410 nt, Artificial Sequence; identical to SEQ ID NO: 113658
  derived and/or modified sequence opt2 from neuraminidase__InfluenzaA__AHL98084

SEQ ID NO: 116424 - RNA, 1410 nt, Artificial Sequence; identical to SEQ ID NO: 115395
  derived and/or modified sequence opt2 from neuraminidase__InfluenzaA__AHL98096

SEQ ID NO: 116425 - RNA, 1410 nt, Artificial Sequence; identical to SEQ ID NO: 113658
  derived and/or modified sequence opt2 from neuraminidase__InfluenzaA__AHL98119

SEQ ID NO: 116426 - RNA, 1410 nt, Artificial Sequence; identical to SEQ ID NO: 113658
  derived and/or modified sequence opt2 from neuraminidase__InfluenzaA__AHL98131

SEQ ID NO: 116427 - RNA, 1410 nt, Artificial Sequence; identical to SEQ ID NO: 113658
  derived and/or modified sequence opt2 from neuraminidase__InfluenzaA__AHL98143

SEQ ID NO: 116428 - RNA, 1410 nt, Artificial Sequence
  derived and/or modified sequence opt2 from neuraminidase__InfluenzaA__AHL98155
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaacuccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116429 - RNA, 1410 nt, Artificial Sequence; identical to SEQ ID NO: 113658
  derived and/or modified sequence opt2 from neuraminidase__InfluenzaA__AHL98167

SEQ ID NO: 116430 - RNA, 1410 nt, Artificial Sequence; identical to SEQ ID NO: 113658
  derived and/or modified sequence opt2 from neuraminidase__InfluenzaA__AHL98179

SEQ ID NO: 116431 - RNA, 1410 nt, Artificial Sequence; identical to SEQ ID NO: 113658
  derived and/or modified sequence opt2 from neuraminidase__InfluenzaA__AHL98191

SEQ ID NO: 116432 - RNA, 1410 nt, Artificial Sequence; identical to SEQ ID NO: 115395
  derived and/or modified sequence opt2 from neuraminidase__InfluenzaA__AHL98215

SEQ ID NO: 116433 - RNA, 1410 nt, Artificial Sequence
  derived and/or modified sequence opt2 from neuraminidase__InfluenzaA__AHL98227
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgacaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116434 - RNA, 1410 nt, Artificial Sequence; identical to SEQ ID NO: 113658
  derived and/or modified sequence opt2 from neuraminidase__InfluenzaA__AHL98239

SEQ ID NO: 116435 - RNA, 1410 nt, Artificial Sequence; identical to SEQ ID NO: 113658
  derived and/or modified sequence opt2 from neuraminidase__InfluenzaA__AHL98251

SEQ ID NO: 116436 - RNA, 1410 nt, Artificial Sequence; identical to SEQ ID NO: 115406
  derived and/or modified sequence opt2 from neuraminidase__InfluenzaA__AHL98263

SEQ ID NO: 116437 - RNA, 1410 nt, Artificial Sequence; identical to SEQ ID NO: 113658
  derived and/or modified sequence opt2 from neuraminidase__InfluenzaA__AHL98275

SEQ ID NO: 116438 - RNA, 1410 nt, Artificial Sequence; identical to SEQ ID NO: 116304
  derived and/or modified sequence opt2 from neuraminidase__InfluenzaA__AHL98287

SEQ ID NO: 116439 - RNA, 1410 nt, Artificial Sequence
  derived and/or modified sequence opt2 from neuraminidase__InfluenzaA__AHL98298
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucggccgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116440 - RNA, 1410 nt, Artificial Sequence; identical to SEQ ID NO: 113658
  derived and/or modified sequence opt2 from neuraminidase__InfluenzaA__AHL98310

SEQ ID NO: 116441 - RNA, 1410 nt, Artificial Sequence; identical to SEQ ID NO: 113658
  derived and/or modified sequence opt2 from neuraminidase__InfluenzaA__AHL98322

SEQ ID NO: 116442 - RNA, 1410 nt, Artificial Sequence
  derived and/or modified sequence opt2 from neuraminidase__InfluenzaA__AHL98334
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgaggucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116443 - RNA, 1410 nt, Artificial Sequence
  derived and/or modified sequence opt2 from neuraminidase__InfluenzaA__AHL98346
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 116444 - RNA, 1410 nt, Artificial Sequence; identical to SEQ ID NO: 113658
  derived and/or modified sequence opt2 from neuraminidase__InfluenzaA__AHL98357

SEQ ID NO: 116445 - RNA, 1410 nt, Artificial Sequence; identical to SEQ ID NO: 115406
  derived and/or modified sequence opt2 from neuraminidase__InfluenzaA__AHL98369

SEQ ID NO: 116446 - RNA, 1410 nt, Artificial Sequence
  derived and/or modified sequence opt2 from neuraminidase__InfluenzaA__AHL98381
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacaugcacuccaacaacaccguccgcgaccgcacccccuaccgcacccuccucauguccgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaccgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116447 - RNA, 1410 nt, Artificial Sequence
  derived and/or modified sequence opt2 from neuraminidase__InfluenzaA__AHL98393
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgaccagcacaucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116448 - RNA, 1410 nt, Artificial Sequence; identical to SEQ ID NO: 113658
  derived and/or modified sequence opt2 from neuraminidase__InfluenzaA__AHL98405

SEQ ID NO: 116449 - RNA, 1410 nt, Artificial Sequence; identical to SEQ ID NO: 113658
  derived and/or modified sequence opt2 from neuraminidase__InfluenzaA__AHL98417

SEQ ID NO: 116450 - RNA, 1410 nt, Artificial Sequence; identical to SEQ ID NO: 113658
  derived and/or modified sequence opt2 from neuraminidase__InfluenzaA__AHL98429

SEQ ID NO: 116451 - RNA, 1410 nt, Artificial Sequence
  derived and/or modified sequence opt2 from neuraminidase__InfluenzaA__AHL98452
augaaccccacccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116452 - RNA, 1410 nt, Artificial Sequence
  derived and/or modified sequence opt2 from neuraminidase__InfluenzaA__AHL98474
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccaacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116453 - RNA, 1410 nt, Artificial Sequence
  derived and/or modified sequence opt2 from neuraminidase__InfluenzaA__AHL98485
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccauccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116454 - RNA, 1410 nt, Artificial Sequence; identical to SEQ ID NO: 114887
  derived and/or modified sequence opt2 from neuraminidase__InfluenzaA__AHL98497

SEQ ID NO: 116455 - RNA, 1410 nt, Artificial Sequence; identical to SEQ ID NO: 113658
  derived and/or modified sequence opt2 from neuraminidase__InfluenzaA__AHL98509

SEQ ID NO: 116456 - RNA, 1410 nt, Artificial Sequence; identical to SEQ ID NO: 113658
  derived and/or modified sequence opt2 from neuraminidase__InfluenzaA__AHL98521

SEQ ID NO: 116457 - RNA, 1410 nt, Artificial Sequence; identical to SEQ ID NO: 114887
  derived and/or modified sequence opt2 from neuraminidase__InfluenzaA__AHL98533

SEQ ID NO: 116458 - RNA, 1410 nt, Artificial Sequence; identical to SEQ ID NO: 113658
  derived and/or modified sequence opt2 from neuraminidase__InfluenzaA__AHL98545

SEQ ID NO: 116459 - RNA, 1410 nt, Artificial Sequence; identical to SEQ ID NO: 113658
  derived and/or modified sequence opt2 from neuraminidase__InfluenzaA__AHL98557

SEQ ID NO: 116460 - RNA, 1410 nt, Artificial Sequence; identical to SEQ ID NO: 113658
  derived and/or modified sequence opt2 from neuraminidase__InfluenzaA__AHL98569

SEQ ID NO: 116461 - RNA, 1410 nt, Artificial Sequence
  derived and/or modified sequence opt2 from neuraminidase__InfluenzaA__AHL98581
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcaacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116462 - RNA, 1410 nt, Artificial Sequence; identical to SEQ ID NO: 113658
  derived and/or modified sequence opt2 from neuraminidase__InfluenzaA__AHL98593

SEQ ID NO: 116463 - RNA, 1410 nt, Artificial Sequence; identical to SEQ ID NO: 115395
  derived and/or modified sequence opt2 from neuraminidase__InfluenzaA__AHL98605

SEQ ID NO: 116464 - RNA, 1410 nt, Artificial Sequence; identical to SEQ ID NO: 114887
  derived and/or modified sequence opt2 from neuraminidase__InfluenzaA__AHL98617

SEQ ID NO: 116465 - RNA, 1410 nt, Artificial Sequence; identical to SEQ ID NO: 114887
  derived and/or modified sequence opt2 from neuraminidase__InfluenzaA__AHL98629

SEQ ID NO: 116466 - RNA, 1410 nt, Artificial Sequence; identical to SEQ ID NO: 113658
  derived and/or modified sequence opt2 from neuraminidase__InfluenzaA__AHL98641

SEQ ID NO: 116467 - RNA, 1410 nt, Artificial Sequence; identical to SEQ ID NO: 116236
  derived and/or modified sequence opt2 from neuraminidase__InfluenzaA__AHL98653

SEQ ID NO: 116468 - RNA, 1410 nt, Artificial Sequence; identical to SEQ ID NO: 113658
  derived and/or modified sequence opt2 from neuraminidase__InfluenzaA__AHL98665

SEQ ID NO: 116469 - RNA, 1410 nt, Artificial Sequence
  derived and/or modified sequence opt2 from neuraminidase__InfluenzaA__AHL98677
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcaccccccaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcaacgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116470 - RNA, 1410 nt, Artificial Sequence; identical to SEQ ID NO: 115406
  derived and/or modified sequence opt2 from neuraminidase__InfluenzaA__AHL98689

SEQ ID NO: 116471 - RNA, 1410 nt, Artificial Sequence
  derived and/or modified sequence opt2 from neuraminidase__InfluenzaA__AHL98702
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116472 - RNA, 1410 nt, Artificial Sequence; identical to SEQ ID NO: 114901
  derived and/or modified sequence opt2 from neuraminidase__InfluenzaA__AHL98714

SEQ ID NO: 116473 - RNA, 1410 nt, Artificial Sequence
  derived and/or modified sequence opt2 from neuraminidase__InfluenzaA__AHL98725
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcggcaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcaacgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacgagaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116474 - RNA, 1410 nt, Artificial Sequence; identical to SEQ ID NO: 115395
  derived and/or modified sequence opt2 from neuraminidase__InfluenzaA__AHL98737

SEQ ID NO: 116475 - RNA, 1410 nt, Artificial Sequence; identical to SEQ ID NO: 115383
  derived and/or modified sequence opt2 from neuraminidase__InfluenzaA__AHL98749

SEQ ID NO: 116476 - RNA, 1410 nt, Artificial Sequence; identical to SEQ ID NO: 115395
  derived and/or modified sequence opt2 from neuraminidase__InfluenzaA__AHL98761

SEQ ID NO: 116477 - RNA, 1410 nt, Artificial Sequence
  derived and/or modified sequence opt2 from neuraminidase__InfluenzaA__AHL98773
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcaacaucugggucacccgcgagcccuacgucuccugcgaccccgacaagugcuaccaguucgcccucggccagggcaccacccucaacaacguccacuccaacaacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116478 - RNA, 1410 nt, Artificial Sequence; identical to SEQ ID NO: 115415
  derived and/or modified sequence opt2 from neuraminidase__InfluenzaA__AHL98785

SEQ ID NO: 116479 - RNA, 1410 nt, Artificial Sequence
  derived and/or modified sequence opt2 from neuraminidase__InfluenzaA__AHL98797
augaaccccaaccagaagaucaucaccaucggcuccgucucccucaccaucuccaccaucugcuucuucacccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgcuccggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116480 - RNA, 1410 nt, Artificial Sequence; identical to SEQ ID NO: 113658
  derived and/or modified sequence opt2 from neuraminidase__InfluenzaA__AHL98809

SEQ ID NO: 116481 - RNA, 1410 nt, Artificial Sequence
  derived and/or modified sequence opt2 from neuraminidase__InfluenzaA__AHL98821
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgaccgcugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116482 - RNA, 1410 nt, Artificial Sequence; identical to SEQ ID NO: 113658
  derived and/or modified sequence opt2 from neuraminidase__InfluenzaA__AHL98833

SEQ ID NO: 116483 - RNA, 1410 nt, Artificial Sequence
  derived and/or modified sequence opt2 from neuraminidase__InfluenzaA__AHL98845
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaucaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116484 - RNA, 1410 nt, Artificial Sequence; identical to SEQ ID NO: 115395
  derived and/or modified sequence opt2 from neuraminidase__InfluenzaA__AHL98857

SEQ ID NO: 116485 - RNA, 1410 nt, Artificial Sequence; identical to SEQ ID NO: 115395
  derived and/or modified sequence opt2 from neuraminidase__InfluenzaA__AHL98869

SEQ ID NO: 116486 - RNA, 1410 nt, Artificial Sequence; identical to SEQ ID NO: 113658
  derived and/or modified sequence opt2 from neuraminidase__InfluenzaA__AHL98881

SEQ ID NO: 116487 - RNA, 1410 nt, Artificial Sequence
  derived and/or modified sequence opt2 from neuraminidase__InfluenzaA__AHL98893
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucuucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116488 - RNA, 1410 nt, Artificial Sequence; identical to SEQ ID NO: 115383
  derived and/or modified sequence opt2 from neuraminidase__InfluenzaA__AHL98905

SEQ ID NO: 116489 - RNA, 1410 nt, Artificial Sequence; identical to SEQ ID NO: 113658
  derived and/or modified sequence opt2 from neuraminidase__InfluenzaA__AHL98916

SEQ ID NO: 116490 - RNA, 1410 nt, Artificial Sequence; identical to SEQ ID NO: 115406
  derived and/or modified sequence opt2 from neuraminidase__InfluenzaA__AHL98928

SEQ ID NO: 116491 - RNA, 1410 nt, Artificial Sequence; identical to SEQ ID NO: 113658
  derived and/or modified sequence opt2 from neuraminidase__InfluenzaA__AHL98940

SEQ ID NO: 116492 - RNA, 1410 nt, Artificial Sequence; identical to SEQ ID NO: 113658
  derived and/or modified sequence opt2 from neuraminidase__InfluenzaA__AHL98952

SEQ ID NO: 116493 - RNA, 1410 nt, Artificial Sequence; identical to SEQ ID NO: 115383
  derived and/or modified sequence opt2 from neuraminidase__InfluenzaA__AHL98964

SEQ ID NO: 116494 - RNA, 1410 nt, Artificial Sequence
  derived and/or modified sequence opt2 from neuraminidase__InfluenzaA__AHL98976
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucgucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgccuccugguccaaggagguccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116495 - RNA, 1410 nt, Artificial Sequence; identical to SEQ ID NO: 115383
  derived and/or modified sequence opt2 from neuraminidase__InfluenzaA__AHL98988

SEQ ID NO: 116496 - RNA, 1410 nt, Artificial Sequence; identical to SEQ ID NO: 113658
  derived and/or modified sequence opt2 from neuraminidase__InfluenzaA__AHL99000

SEQ ID NO: 116497 - RNA, 1410 nt, Artificial Sequence; identical to SEQ ID NO: 113658
  derived and/or modified sequence opt2 from neuraminidase__InfluenzaA__AHL99012

SEQ ID NO: 116498 - RNA, 1410 nt, Artificial Sequence
  derived and/or modified sequence opt2 from neuraminidase__InfluenzaA__AHL99024
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcaucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116499 - RNA, 1410 nt, Artificial Sequence; identical to SEQ ID NO: 114876
  derived and/or modified sequence opt2 from neuraminidase__InfluenzaA__AHL99036

SEQ ID NO: 116500 - RNA, 1410 nt, Artificial Sequence; identical to SEQ ID NO: 116298
  derived and/or modified sequence opt2 from neuraminidase__InfluenzaA__AHL99048

SEQ ID NO: 116501 - RNA, 1410 nt, Artificial Sequence; identical to SEQ ID NO: 113658
  derived and/or modified sequence opt2 from neuraminidase__InfluenzaA__AHL99060

SEQ ID NO: 116502 - RNA, 1410 nt, Artificial Sequence
  derived and/or modified sequence opt2 from neuraminidase__InfluenzaA__AHL99072
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116503 - RNA, 1410 nt, Artificial Sequence
  derived and/or modified sequence opt2 from neuraminidase__InfluenzaA__AHL99084
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgaccgcugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacaacaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116504 - RNA, 1410 nt, Artificial Sequence; identical to SEQ ID NO: 113658
  derived and/or modified sequence opt2 from neuraminidase__InfluenzaA__AHL99096

SEQ ID NO: 116505 - RNA, 1410 nt, Artificial Sequence; identical to SEQ ID NO: 113658
  derived and/or modified sequence opt2 from neuraminidase__InfluenzaA__AHL99108

SEQ ID NO: 116506 - RNA, 1410 nt, Artificial Sequence; identical to SEQ ID NO: 113658
  derived and/or modified sequence opt2 from neuraminidase__InfluenzaA__AHL99120

SEQ ID NO: 116507 - RNA, 1410 nt, Artificial Sequence; identical to SEQ ID NO: 113658
  derived and/or modified sequence opt2 from neuraminidase__InfluenzaA__AHL99132

SEQ ID NO: 116508 - RNA, 1410 nt, Artificial Sequence
  derived and/or modified sequence opt2 from neuraminidase__InfluenzaA__AHL99144
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggccgcaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116509 - RNA, 1410 nt, Artificial Sequence; identical to SEQ ID NO: 113658
  derived and/or modified sequence opt2 from neuraminidase__InfluenzaA__AHL99156

SEQ ID NO: 116510 - RNA, 1410 nt, Artificial Sequence
  derived and/or modified sequence opt2 from neuraminidase__InfluenzaA__AHL99168
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaccaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116511 - RNA, 1410 nt, Artificial Sequence; identical to SEQ ID NO: 113658
  derived and/or modified sequence opt2 from neuraminidase__InfluenzaA__AHL99180

SEQ ID NO: 116512 - RNA, 1410 nt, Artificial Sequence; identical to SEQ ID NO: 114522
  derived and/or modified sequence opt2 from neuraminidase__InfluenzaA__AHL99204

SEQ ID NO: 116513 - RNA, 1410 nt, Artificial Sequence
  derived and/or modified sequence opt2 from neuraminidase__InfluenzaA__AHL99216
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccgucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucaucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaagaaggagaccgagguccucuggaccuccaacuccaucgucgucuucugcggcaccuccggcaccuacggcaccggcuccuggcccgacggcgccgaccucaaccucaugcccaucuga

SEQ ID NO: 116514 - RNA, 1410 nt, Artificial Sequence; identical to SEQ ID NO: 113658
  derived and/or modified sequence opt2 from neuraminidase__InfluenzaA__AHL99228

SEQ ID NO: 116515 - RNA, 1410 nt, Artificial Sequence; identical to SEQ ID NO: 113658
  derived and/or modified sequence opt2 from neuraminidase__InfluenzaA__AHL99240

SEQ ID NO: 116516 - RNA, 1410 nt, Artificial Sequence; identical to SEQ ID NO: 113658
  derived and/or modified sequence opt2 from neuraminidase__InfluenzaA__AHL99252

SEQ ID NO: 116517 - RNA, 1410 nt, Artificial Sequence; identical to SEQ ID NO: 113658
  derived and/or modified sequence opt2 from neuraminidase__InfluenzaA__AHL99264

SEQ ID NO: 116518 - RNA, 1410 nt, Artificial Sequence; identical to SEQ ID NO: 113658
  derived and/or modified sequence opt2 from neuraminidase__InfluenzaA__AHL99276

SEQ ID NO: 116519 - RNA, 1410 nt, Artificial Sequence; identical to SEQ ID NO: 115395
  derived and/or modified sequence opt2 from neuraminidase__InfluenzaA__AHL99288

SEQ ID NO: 116520 - RNA, 1410 nt, Artificial Sequence; identical to SEQ ID NO: 116298
  derived and/or modified sequence opt2 from neuraminidase__InfluenzaA__AHL99300

SEQ ID NO: 116521 - RNA, 1410 nt, Artificial Sequence; identical to SEQ ID NO: 113658
  derived and/or modified sequence opt2 from neuraminidase__InfluenzaA__AHL99312

SEQ ID NO: 116522 - RNA, 1410 nt, Artificial Sequence
  derived and/or modified sequence opt2 from neuraminidase__InfluenzaA__AHL99324
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucauccucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116523 - RNA, 1410 nt, Artificial Sequence; identical to SEQ ID NO: 114901
  derived and/or modified sequence opt2 from neuraminidase__InfluenzaA__AHL99348

SEQ ID NO: 116524 - RNA, 1410 nt, Artificial Sequence; identical to SEQ ID NO: 114901
  derived and/or modified sequence opt2 from neuraminidase__InfluenzaA__AHL99359

SEQ ID NO: 116525 - RNA, 1410 nt, Artificial Sequence
  derived and/or modified sequence opt2 from neuraminidase__InfluenzaA__AHL99370
augaaccccaaccagaagaucaucaccaucggcuccgucucccucaccaucaccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116526 - RNA, 1410 nt, Artificial Sequence; identical to SEQ ID NO: 113658
  derived and/or modified sequence opt2 from neuraminidase__InfluenzaA__AHL99393

SEQ ID NO: 116527 - RNA, 1410 nt, Artificial Sequence; identical to SEQ ID NO: 113658
  derived and/or modified sequence opt2 from neuraminidase__InfluenzaA__AHL99417

SEQ ID NO: 116528 - RNA, 1410 nt, Artificial Sequence; identical to SEQ ID NO: 113658
  derived and/or modified sequence opt2 from neuraminidase__InfluenzaA__AHL99429

SEQ ID NO: 116529 - RNA, 1410 nt, Artificial Sequence; identical to SEQ ID NO: 113658
  derived and/or modified sequence opt2 from neuraminidase__InfluenzaA__AHL99441

SEQ ID NO: 116530 - RNA, 1410 nt, Artificial Sequence; identical to SEQ ID NO: 113658
  derived and/or modified sequence opt2 from neuraminidase__InfluenzaA__AHL99453

SEQ ID NO: 116531 - RNA, 1410 nt, Artificial Sequence; identical to SEQ ID NO: 113658
  derived and/or modified sequence opt2 from neuraminidase__InfluenzaA__AHL99477

SEQ ID NO: 116532 - RNA, 1410 nt, Artificial Sequence; identical to SEQ ID NO: 116298
  derived and/or modified sequence opt2 from neuraminidase__InfluenzaA__AHL99489

SEQ ID NO: 116533 - RNA, 1410 nt, Artificial Sequence
  derived and/or modified sequence opt2 from neuraminidase__InfluenzaA__AHL99501
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaccgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116534 - RNA, 1410 nt, Artificial Sequence; identical to SEQ ID NO: 113658
  derived and/or modified sequence opt2 from neuraminidase__InfluenzaA__AHL99525

SEQ ID NO: 116535 - RNA, 1410 nt, Artificial Sequence
  derived and/or modified sequence opt2 from neuraminidase__InfluenzaA__AHL99537
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcaccuccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116536 - RNA, 1410 nt, Artificial Sequence; identical to SEQ ID NO: 115395
  derived and/or modified sequence opt2 from neuraminidase__InfluenzaA__AHL99549

SEQ ID NO: 116537 - RNA, 1410 nt, Artificial Sequence; identical to SEQ ID NO: 113658
  derived and/or modified sequence opt2 from neuraminidase__InfluenzaA__AHL99561

SEQ ID NO: 116538 - RNA, 1410 nt, Artificial Sequence
  derived and/or modified sequence opt2 from neuraminidase__InfluenzaA__AHL99573
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccggcgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucaucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116539 - RNA, 1410 nt, Artificial Sequence
  derived and/or modified sequence opt2 from neuraminidase__InfluenzaA__AHL99585
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116540 - RNA, 1410 nt, Artificial Sequence
  derived and/or modified sequence opt2 from neuraminidase__InfluenzaA__AHL99597
augaaccccaaccagaagaucaucaccaucggcuccgucugcaugaccaucggcauggccaaccucauccuccagaucggcaacaucaucuccaucuggaucucccacuccauccaggucggcaaccagucccagaucgagaccugcaaccaguccgucaucaccuacgagaacaacaccugggucaaccagaccuacgucaacaucuccaacaccaacuucgccgucggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacgacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116541 - RNA, 1410 nt, Artificial Sequence
  derived and/or modified sequence opt2 from neuraminidase__InfluenzaA__AHL99608
augaaccccaaccagaagaucaucaccaucggcuccgucucccucaccaucuccaccaucugcgucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116542 - RNA, 1410 nt, Artificial Sequence
  derived and/or modified sequence opt2 from neuraminidase__InfluenzaA__AHL99620
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116543 - RNA, 1410 nt, Artificial Sequence
  derived and/or modified sequence opt2 from neuraminidase__InfluenzaA__AHL99632
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaccaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116544 - RNA, 1410 nt, Artificial Sequence; identical to SEQ ID NO: 116333
  derived and/or modified sequence opt2 from neuraminidase__InfluenzaA__AHL99644

SEQ ID NO: 116545 - RNA, 1410 nt, Artificial Sequence
  derived and/or modified sequence opt2 from neuraminidase__InfluenzaA__AHL99668
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccgucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucaucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116546 - RNA, 1410 nt, Artificial Sequence; identical to SEQ ID NO: 113658
  derived and/or modified sequence opt2 from neuraminidase__InfluenzaA__AHL99680

SEQ ID NO: 116547 - RNA, 1410 nt, Artificial Sequence
  derived and/or modified sequence opt2 from neuraminidase__InfluenzaA__AHL99692
augaaccccaaccagaagaucaucaccaucggcuccgucucccucaccaucuccaccaccugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116548 - RNA, 1410 nt, Artificial Sequence; identical to SEQ ID NO: 113658
  derived and/or modified sequence opt2 from neuraminidase__InfluenzaA__AHL99704

SEQ ID NO: 116549 - RNA, 1410 nt, Artificial Sequence; identical to SEQ ID NO: 113658
  derived and/or modified sequence opt2 from neuraminidase__InfluenzaA__AHL99716

SEQ ID NO: 116550 - RNA, 1410 nt, Artificial Sequence; identical to SEQ ID NO: 116540
  derived and/or modified sequence opt2 from neuraminidase__InfluenzaA__AHL99740

SEQ ID NO: 116551 - RNA, 1410 nt, Artificial Sequence
  derived and/or modified sequence opt2 from neuraminidase__InfluenzaA__AHL99751
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccgucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116552 - RNA, 1410 nt, Artificial Sequence
  derived and/or modified sequence opt2 from neuraminidase__InfluenzaA__AHL99763
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaugaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116553 - RNA, 1410 nt, Artificial Sequence; identical to SEQ ID NO: 113658
  derived and/or modified sequence opt2 from neuraminidase__InfluenzaA__AHL99775

SEQ ID NO: 116554 - RNA, 1410 nt, Artificial Sequence
  derived and/or modified sequence opt2 from neuraminidase__InfluenzaA__AHL99787
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccgaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116555 - RNA, 1410 nt, Artificial Sequence
  derived and/or modified sequence opt2 from neuraminidase__InfluenzaA__AHL99799
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcaucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucggccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116556 - RNA, 1410 nt, Artificial Sequence; identical to SEQ ID NO: 113658
  derived and/or modified sequence opt2 from neuraminidase__InfluenzaA__AHL99811

SEQ ID NO: 116557 - RNA, 1410 nt, Artificial Sequence
  derived and/or modified sequence opt2 from neuraminidase__InfluenzaA__AHL99823
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116558 - RNA, 1410 nt, Artificial Sequence
  derived and/or modified sequence opt2 from neuraminidase__InfluenzaA__AHL99835
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgcccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccucaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116559 - RNA, 1410 nt, Artificial Sequence; identical to SEQ ID NO: 113658
  derived and/or modified sequence opt2 from neuraminidase__InfluenzaA__AHL99847

SEQ ID NO: 116560 - RNA, 1410 nt, Artificial Sequence; identical to SEQ ID NO: 114887
  derived and/or modified sequence opt2 from neuraminidase__InfluenzaA__AHL99859

SEQ ID NO: 116561 - RNA, 1410 nt, Artificial Sequence
  derived and/or modified sequence opt2 from neuraminidase__InfluenzaA__AHL99871
augaaccccaaccagaagaucaucaccaucggcuccgucucccucaccaucuccaccaucugcuucuucaugcagaucgccauccucaccaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggccgcaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116562 - RNA, 1410 nt, Artificial Sequence; identical to SEQ ID NO: 113658
  derived and/or modified sequence opt2 from neuraminidase__InfluenzaA__AHL99883

SEQ ID NO: 116563 - RNA, 1410 nt, Artificial Sequence; identical to SEQ ID NO: 116539
  derived and/or modified sequence opt2 from neuraminidase__InfluenzaA__AHL99895

SEQ ID NO: 116564 - RNA, 1410 nt, Artificial Sequence; identical to SEQ ID NO: 113658
  derived and/or modified sequence opt2 from neuraminidase__InfluenzaA__AHL99907

SEQ ID NO: 116565 - RNA, 1410 nt, Artificial Sequence; identical to SEQ ID NO: 113658
  derived and/or modified sequence opt2 from neuraminidase__InfluenzaA__AHL99919

SEQ ID NO: 116566 - RNA, 1410 nt, Artificial Sequence
  derived and/or modified sequence opt2 from neuraminidase__InfluenzaA__AHL99943
augaaccccaaccagaagaucaucaccaucggcuccgucucccucaccaucuccaccaucugcuucuucaugcagaucgccauccucaucaccaccgucacccuccacuucaagcagcacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116567 - RNA, 1410 nt, Artificial Sequence; identical to SEQ ID NO: 113658
  derived and/or modified sequence opt2 from neuraminidase__InfluenzaA__AHL99955

SEQ ID NO: 116568 - RNA, 1410 nt, Artificial Sequence
  derived and/or modified sequence opt2 from neuraminidase__InfluenzaA__AHL99967
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116569 - RNA, 1410 nt, Artificial Sequence
  derived and/or modified sequence opt2 from neuraminidase__InfluenzaA__AHL99979
augaaccccaaccagaagaucaucaccaucggcuccgucucccucaccaucuccaccaucugcuucuucaugcagaucgccauccucaucaccaccgucgcccuccacuucaagcagcacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116570 - RNA, 1410 nt, Artificial Sequence; identical to SEQ ID NO: 116566
  derived and/or modified sequence opt2 from neuraminidase__InfluenzaA__AHL99991

SEQ ID NO: 116571 - RNA, 1410 nt, Artificial Sequence; identical to SEQ ID NO: 113658
  derived and/or modified sequence opt2 from neuraminidase__InfluenzaA__AHM00004

SEQ ID NO: 116572 - RNA, 1410 nt, Artificial Sequence; identical to SEQ ID NO: 113658
  derived and/or modified sequence opt2 from neuraminidase__InfluenzaA__AHM00016

SEQ ID NO: 116573 - RNA, 1410 nt, Artificial Sequence; identical to SEQ ID NO: 113658
  derived and/or modified sequence opt2 from neuraminidase__InfluenzaA__AHM00028

SEQ ID NO: 116574 - RNA, 1410 nt, Artificial Sequence; identical to SEQ ID NO: 116566
  derived and/or modified sequence opt2 from neuraminidase__InfluenzaA__AHM00040

SEQ ID NO: 116575 - RNA, 1410 nt, Artificial Sequence; identical to SEQ ID NO: 113658
  derived and/or modified sequence opt2 from neuraminidase__InfluenzaA__AHM00052

SEQ ID NO: 116576 - RNA, 1410 nt, Artificial Sequence; identical to SEQ ID NO: 114522
  derived and/or modified sequence opt2 from neuraminidase__InfluenzaA__AHM00064

SEQ ID NO: 116577 - RNA, 1410 nt, Artificial Sequence; identical to SEQ ID NO: 113658
  derived and/or modified sequence opt2 from neuraminidase__InfluenzaA__AHM00076

SEQ ID NO: 116578 - RNA, 1410 nt, Artificial Sequence; identical to SEQ ID NO: 113658
  derived and/or modified sequence opt2 from neuraminidase__InfluenzaA__AHM00088

SEQ ID NO: 116579 - RNA, 1410 nt, Artificial Sequence
  derived and/or modified sequence opt2 from neuraminidase__InfluenzaA__AHM00100
augaaccccaaccagaagaucaucaccaucggcuccaucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcgucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaccaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaacuga

SEQ ID NO: 116580 - RNA, 1410 nt, Artificial Sequence; identical to SEQ ID NO: 116502
  derived and/or modified sequence opt2 from neuraminidase__InfluenzaA__AHM00111

SEQ ID NO: 116581 - RNA, 1410 nt, Artificial Sequence; identical to SEQ ID NO: 116566
  derived and/or modified sequence opt2 from neuraminidase__InfluenzaA__AHM00123

SEQ ID NO: 116582 - RNA, 1410 nt, Artificial Sequence; identical to SEQ ID NO: 114887
  derived and/or modified sequence opt2 from neuraminidase__InfluenzaA__AHM00135

SEQ ID NO: 116583 - RNA, 1410 nt, Artificial Sequence; identical to SEQ ID NO: 115395
  derived and/or modified sequence opt2 from neuraminidase__InfluenzaA__AHM00147

SEQ ID NO: 116584 - RNA, 1410 nt, Artificial Sequence; identical to SEQ ID NO: 116566
  derived and/or modified sequence opt2 from neuraminidase__InfluenzaA__AHM00159

SEQ ID NO: 116585 - RNA, 1410 nt, Artificial Sequence; identical to SEQ ID NO: 113658
  derived and/or modified sequence opt2 from neuraminidase__InfluenzaA__AHM00171

SEQ ID NO: 116586 - RNA, 1410 nt, Artificial Sequence; identical to SEQ ID NO: 113658
  derived and/or modified sequence opt2 from neuraminidase__InfluenzaA__AHM00183

SEQ ID NO: 116587 - RNA, 1410 nt, Artificial Sequence
  derived and/or modified sequence opt2 from neuraminidase__InfluenzaA__AHM00195
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagguccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116588 - RNA, 1410 nt, Artificial Sequence
  derived and/or modified sequence opt2 from neuraminidase__InfluenzaA__AHM00207
augaaccccaaccagaagaucaucaccaucggcuccgucucccucaccaucuccaccaucugcuucuucaugcagaucgccauccucaucaccaccgucacccuccacuucaagcagcacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcaacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116589 - RNA, 1410 nt, Artificial Sequence; identical to SEQ ID NO: 116566
  derived and/or modified sequence opt2 from neuraminidase__InfluenzaA__AHM00219

SEQ ID NO: 116590 - RNA, 1410 nt, Artificial Sequence; identical to SEQ ID NO: 113658
  derived and/or modified sequence opt2 from neuraminidase__InfluenzaA__AHM00231

SEQ ID NO: 116591 - RNA, 1410 nt, Artificial Sequence; identical to SEQ ID NO: 113658
  derived and/or modified sequence opt2 from neuraminidase__InfluenzaA__AHM00243

SEQ ID NO: 116592 - RNA, 1410 nt, Artificial Sequence; identical to SEQ ID NO: 113658
  derived and/or modified sequence opt2 from neuraminidase__InfluenzaA__AHM00255

SEQ ID NO: 116593 - RNA, 1410 nt, Artificial Sequence
  derived and/or modified sequence opt2 from neuraminidase__InfluenzaA__AHM00267
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgccuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116594 - RNA, 1410 nt, Artificial Sequence; identical to SEQ ID NO: 114887
  derived and/or modified sequence opt2 from neuraminidase__InfluenzaA__AHM00279

SEQ ID NO: 116595 - RNA, 1410 nt, Artificial Sequence; identical to SEQ ID NO: 113658
  derived and/or modified sequence opt2 from neuraminidase__InfluenzaA__AHM00291

SEQ ID NO: 116596 - RNA, 1410 nt, Artificial Sequence; identical to SEQ ID NO: 113658
  derived and/or modified sequence opt2 from neuraminidase__InfluenzaA__AHM00303

SEQ ID NO: 116597 - RNA, 1410 nt, Artificial Sequence; identical to SEQ ID NO: 113658
  derived and/or modified sequence opt2 from neuraminidase__InfluenzaA__AHM00315

SEQ ID NO: 116598 - RNA, 1410 nt, Artificial Sequence; identical to SEQ ID NO: 114887
  derived and/or modified sequence opt2 from neuraminidase__InfluenzaA__AHM00327

SEQ ID NO: 116599 - RNA, 1410 nt, Artificial Sequence; identical to SEQ ID NO: 114887
  derived and/or modified sequence opt2 from neuraminidase__InfluenzaA__AHM00339

SEQ ID NO: 116600 - RNA, 1410 nt, Artificial Sequence; identical to SEQ ID NO: 116566
  derived and/or modified sequence opt2 from neuraminidase__InfluenzaA__AHM00351

SEQ ID NO: 116601 - RNA, 1410 nt, Artificial Sequence; identical to SEQ ID NO: 116502
  derived and/or modified sequence opt2 from neuraminidase__InfluenzaA__AHM00363

SEQ ID NO: 116602 - RNA, 1410 nt, Artificial Sequence
  derived and/or modified sequence opt2 from neuraminidase__InfluenzaA__AHM00375
augaaccccaaccagaagaucaucaccaucggcuccgucucccucaccaucuccaccaucugcuucuucaugcagaucgccauccucaucaccaccgucacccuccacuucaagcagcacgaguucaacuccccccccaacaaccaggucaugcucugcgagcccaccaucaucgagcgcaacaucaccgagaucgucuaccucaccaacaccaccaucgagaaggaggucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116603 - RNA, 1410 nt, Artificial Sequence
  derived and/or modified sequence opt2 from neuraminidase__InfluenzaA__AHM00398
augaaccccaaccagaagaucaucaccaucggcuccgucucccucaccaucuccaccaucugcuucuucaugcagaucgccauccucaucaccaccgucacccuccacuucaagcagcacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggagaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccuccuccaucgucgucuucugcggcaccuccggcaccuacggcaccggcuccuggcccgacggcgccgaccucaaccucaugcccaucuga

SEQ ID NO: 116604 - RNA, 1410 nt, Artificial Sequence; identical to SEQ ID NO: 113658
  derived and/or modified sequence opt2 from neuraminidase__InfluenzaA__AHM00410

SEQ ID NO: 116605 - RNA, 1410 nt, Artificial Sequence
  derived and/or modified sequence opt2 from neuraminidase__InfluenzaA__AHM00422
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116606 - RNA, 1410 nt, Artificial Sequence
  derived and/or modified sequence opt2 from neuraminidase__InfluenzaA__AHM00434
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116607 - RNA, 1410 nt, Artificial Sequence; identical to SEQ ID NO: 113658
  derived and/or modified sequence opt2 from neuraminidase__InfluenzaA__AHM00446

SEQ ID NO: 116608 - RNA, 1410 nt, Artificial Sequence; identical to SEQ ID NO: 116566
  derived and/or modified sequence opt2 from neuraminidase__InfluenzaA__AHM00458

SEQ ID NO: 116609 - RNA, 1410 nt, Artificial Sequence; identical to SEQ ID NO: 116566
  derived and/or modified sequence opt2 from neuraminidase__InfluenzaA__AHM00470

SEQ ID NO: 116610 - RNA, 1410 nt, Artificial Sequence; identical to SEQ ID NO: 116566
  derived and/or modified sequence opt2 from neuraminidase__InfluenzaA__AHM00482

SEQ ID NO: 116611 - RNA, 1410 nt, Artificial Sequence; identical to SEQ ID NO: 116566
  derived and/or modified sequence opt2 from neuraminidase__InfluenzaA__AHM00494

SEQ ID NO: 116612 - RNA, 1410 nt, Artificial Sequence
  derived and/or modified sequence opt2 from neuraminidase__InfluenzaA__AHM00506
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucaaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116613 - RNA, 1410 nt, Artificial Sequence; identical to SEQ ID NO: 113658
  derived and/or modified sequence opt2 from neuraminidase__InfluenzaA__AHM00518

SEQ ID NO: 116614 - RNA, 1410 nt, Artificial Sequence
  derived and/or modified sequence opt2 from neuraminidase__InfluenzaA__AHM00530
augaaccccaaccagaagaucaucaccaucggcuccgucucccucaccaucuccaccaucugcuucuccaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116615 - RNA, 1410 nt, Artificial Sequence; identical to SEQ ID NO: 114887
  derived and/or modified sequence opt2 from neuraminidase__InfluenzaA__AHM00542

SEQ ID NO: 116616 - RNA, 1410 nt, Artificial Sequence
  derived and/or modified sequence opt2 from neuraminidase__InfluenzaA__AHM00546
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccaaguacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116617 - RNA, 1410 nt, Artificial Sequence
  derived and/or modified sequence opt2 from neuraminidase__InfluenzaA__AHM00558
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggaggucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116618 - RNA, 1410 nt, Artificial Sequence; identical to SEQ ID NO: 113658
  derived and/or modified sequence opt2 from neuraminidase__InfluenzaA__AHM00570

SEQ ID NO: 116619 - RNA, 1410 nt, Artificial Sequence; identical to SEQ ID NO: 113658
  derived and/or modified sequence opt2 from neuraminidase__InfluenzaA__AHM00582

SEQ ID NO: 116620 - RNA, 1410 nt, Artificial Sequence
  derived and/or modified sequence opt2 from neuraminidase__InfluenzaA__AHM00594
augaaccccaaccagaagaucaucaccaucggcuccgucucccucaccaucuccaccaucugcuucuucaugcagaucgccauccucaucaccaccgucacccuccacuucaagcagcacgaguucaacuccccccccaacaaccaggucaugcucugcgagcccaccaucaucgagcgcaacaucaccgagaucguccaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116621 - RNA, 1410 nt, Artificial Sequence; identical to SEQ ID NO: 113658
  derived and/or modified sequence opt2 from neuraminidase__InfluenzaA__AHM00606

SEQ ID NO: 116622 - RNA, 1410 nt, Artificial Sequence; identical to SEQ ID NO: 113658
  derived and/or modified sequence opt2 from neuraminidase__InfluenzaA__AHM00618

SEQ ID NO: 116623 - RNA, 1410 nt, Artificial Sequence; identical to SEQ ID NO: 113658
  derived and/or modified sequence opt2 from neuraminidase__InfluenzaA__AHM00630

SEQ ID NO: 116624 - RNA, 1410 nt, Artificial Sequence; identical to SEQ ID NO: 113658
  derived and/or modified sequence opt2 from neuraminidase__InfluenzaA__AHM00642

SEQ ID NO: 116625 - RNA, 1410 nt, Artificial Sequence; identical to SEQ ID NO: 114887
  derived and/or modified sequence opt2 from neuraminidase__InfluenzaA__AHM00654

SEQ ID NO: 116626 - RNA, 1410 nt, Artificial Sequence; identical to SEQ ID NO: 113658
  derived and/or modified sequence opt2 from neuraminidase__InfluenzaA__AHM00666

SEQ ID NO: 116627 - RNA, 1410 nt, Artificial Sequence; identical to SEQ ID NO: 116566
  derived and/or modified sequence opt2 from neuraminidase__InfluenzaA__AHM00678

SEQ ID NO: 116628 - RNA, 1410 nt, Artificial Sequence; identical to SEQ ID NO: 114901
  derived and/or modified sequence opt2 from neuraminidase__InfluenzaA__AHM00690

SEQ ID NO: 116629 - RNA, 1410 nt, Artificial Sequence; identical to SEQ ID NO: 114887
  derived and/or modified sequence opt2 from neuraminidase__InfluenzaA__AHM00701

SEQ ID NO: 116630 - RNA, 1410 nt, Artificial Sequence
  derived and/or modified sequence opt2 from neuraminidase__InfluenzaA__AHM00713
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaaguccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116631 - RNA, 1410 nt, Artificial Sequence; identical to SEQ ID NO: 113658
  derived and/or modified sequence opt2 from neuraminidase__InfluenzaA__AHM00725

SEQ ID NO: 116632 - RNA, 1410 nt, Artificial Sequence; identical to SEQ ID NO: 113658
  derived and/or modified sequence opt2 from neuraminidase__InfluenzaA__AHM00737

SEQ ID NO: 116633 - RNA, 1410 nt, Artificial Sequence; identical to SEQ ID NO: 116566
  derived and/or modified sequence opt2 from neuraminidase__InfluenzaA__AHM00749

SEQ ID NO: 116634 - RNA, 1410 nt, Artificial Sequence; identical to SEQ ID NO: 113658
  derived and/or modified sequence opt2 from neuraminidase__InfluenzaA__AHM00761

SEQ ID NO: 116635 - RNA, 1410 nt, Artificial Sequence; identical to SEQ ID NO: 114887
  derived and/or modified sequence opt2 from neuraminidase__InfluenzaA__AHM00785

SEQ ID NO: 116636 - RNA, 1410 nt, Artificial Sequence; identical to SEQ ID NO: 114522
  derived and/or modified sequence opt2 from neuraminidase__InfluenzaA__AHM00797

SEQ ID NO: 116637 - RNA, 1410 nt, Artificial Sequence
  derived and/or modified sequence opt2 from neuraminidase__InfluenzaA__AHM00809
augaaccccaaccagaagaucaucaccaucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116638 - RNA, 1410 nt, Artificial Sequence; identical to SEQ ID NO: 116566
  derived and/or modified sequence opt2 from neuraminidase__InfluenzaA__AHM00821

SEQ ID NO: 116639 - RNA, 1410 nt, Artificial Sequence; identical to SEQ ID NO: 116566
  derived and/or modified sequence opt2 from neuraminidase__InfluenzaA__AHM00833

SEQ ID NO: 116640 - RNA, 1410 nt, Artificial Sequence; identical to SEQ ID NO: 114522
  derived and/or modified sequence opt2 from neuraminidase__InfluenzaA__AHM00845

SEQ ID NO: 116641 - RNA, 1410 nt, Artificial Sequence; identical to SEQ ID NO: 113658
  derived and/or modified sequence opt2 from neuraminidase__InfluenzaA__AHM00857

SEQ ID NO: 116642 - RNA, 1410 nt, Artificial Sequence; identical to SEQ ID NO: 113658
  derived and/or modified sequence opt2 from neuraminidase__InfluenzaA__AHM00869

SEQ ID NO: 116643 - RNA, 1410 nt, Artificial Sequence; identical to SEQ ID NO: 113658
  derived and/or modified sequence opt2 from neuraminidase__InfluenzaA__AHM00881

SEQ ID NO: 116644 - RNA, 1410 nt, Artificial Sequence; identical to SEQ ID NO: 114887
  derived and/or modified sequence opt2 from neuraminidase__InfluenzaA__AHM00893

SEQ ID NO: 116645 - RNA, 1410 nt, Artificial Sequence
  derived and/or modified sequence opt2 from neuraminidase__InfluenzaA__AHM00905
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116646 - RNA, 1410 nt, Artificial Sequence
  derived and/or modified sequence opt2 from neuraminidase__InfluenzaA__AHM00917
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacaucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116647 - RNA, 1410 nt, Artificial Sequence; identical to SEQ ID NO: 113658
  derived and/or modified sequence opt2 from neuraminidase__InfluenzaA__AHM00929

SEQ ID NO: 116648 - RNA, 1410 nt, Artificial Sequence
  derived and/or modified sequence opt2 from neuraminidase__InfluenzaA__AHM00941
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccauccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116649 - RNA, 1410 nt, Artificial Sequence
  derived and/or modified sequence opt2 from neuraminidase__InfluenzaA__AHM00953
augaaccccaaccagaagaucaucaccaucggcuccgucucccucaccaucuccaccaucugcuucuucaugcagaucgccauccucaucaccaccgucacccuccacuucaagcaguacgccuucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116650 - RNA, 1410 nt, Artificial Sequence; identical to SEQ ID NO: 114887
  derived and/or modified sequence opt2 from neuraminidase__InfluenzaA__AHM00965

SEQ ID NO: 116651 - RNA, 1410 nt, Artificial Sequence; identical to SEQ ID NO: 114887
  derived and/or modified sequence opt2 from neuraminidase__InfluenzaA__AHM00977

SEQ ID NO: 116652 - RNA, 1398 nt, Artificial Sequence
  derived and/or modified sequence opt2 from neuraminidase__InfluenzaA__AHM24226
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagaugcucaagugggagucccucaccggcaccgccaagcacaacgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 116653 - RNA, 1398 nt, Artificial Sequence; identical to SEQ ID NO: 114966
  derived and/or modified sequence opt2 from neuraminidase__InfluenzaA__AHM24238

SEQ ID NO: 116654 - RNA, 1398 nt, Artificial Sequence
  derived and/or modified sequence opt2 from neuraminidase__InfluenzaA__AHM24250
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgagaacuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 116655 - RNA, 1410 nt, Artificial Sequence; identical to SEQ ID NO: 112221
  derived and/or modified sequence opt2 from neuraminidase__InfluenzaA__AHM98312

SEQ ID NO: 116656 - RNA, 1410 nt, Artificial Sequence
  derived and/or modified sequence opt2 from neuraminidase__InfluenzaA__AHM98331
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcguccacuccgacaccgucggcugguccuggcccgacggcgccgagcuccccuucaccaucgacaaguga

SEQ ID NO: 116657 - RNA, 1410 nt, Artificial Sequence; identical to SEQ ID NO: 112237
  derived and/or modified sequence opt2 from neuraminidase__InfluenzaA__AHM98342

SEQ ID NO: 116658 - RNA, 1410 nt, Artificial Sequence
  derived and/or modified sequence opt2 from neuraminidase__InfluenzaA__AHM98353
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucgacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116659 - RNA, 1410 nt, Artificial Sequence
  derived and/or modified sequence opt2 from neuraminidase__InfluenzaA__AHM98364
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaaccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116660 - RNA, 1410 nt, Artificial Sequence
  derived and/or modified sequence opt2 from neuraminidase__InfluenzaA__AHM98375
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuuccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116661 - RNA, 1410 nt, Artificial Sequence; identical to SEQ ID NO: 112221
  derived and/or modified sequence opt2 from neuraminidase__InfluenzaA__AHM98386

SEQ ID NO: 116662 - RNA, 1410 nt, Artificial Sequence
  derived and/or modified sequence opt2 from neuraminidase__InfluenzaA__AHM98408
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggaucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116663 - RNA, 1410 nt, Artificial Sequence; identical to SEQ ID NO: 116662
  derived and/or modified sequence opt2 from neuraminidase__InfluenzaA__AHM98419

SEQ ID NO: 116664 - RNA, 1410 nt, Artificial Sequence
  derived and/or modified sequence opt2 from neuraminidase__InfluenzaA__AHM98430
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccagaacgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116665 - RNA, 1410 nt, Artificial Sequence; identical to SEQ ID NO: 112469
  derived and/or modified sequence opt2 from neuraminidase__InfluenzaA__AHM98441

SEQ ID NO: 116666 - RNA, 1410 nt, Artificial Sequence
  derived and/or modified sequence opt2 from neuraminidase__InfluenzaA__AHM98452
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcgucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116667 - RNA, 1410 nt, Artificial Sequence; identical to SEQ ID NO: 112221
  derived and/or modified sequence opt2 from neuraminidase__InfluenzaA__AHM98474

SEQ ID NO: 116668 - RNA, 1410 nt, Artificial Sequence
  derived and/or modified sequence opt2 from neuraminidase__InfluenzaA__AHM98485
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116669 - RNA, 1410 nt, Artificial Sequence
  derived and/or modified sequence opt2 from neuraminidase__InfluenzaA__AHM98496
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaagaaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaagugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116670 - RNA, 1410 nt, Artificial Sequence; identical to SEQ ID NO: 112221
  derived and/or modified sequence opt2 from neuraminidase__InfluenzaA__AHM98507

SEQ ID NO: 116671 - RNA, 1410 nt, Artificial Sequence
  derived and/or modified sequence opt2 from neuraminidase__InfluenzaA__AHM98518
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggaucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccauguccuucugcggcgucaacuccgacaccgucggcugguccuggcccgacggcgccgagcuccccuucaccaucgacaaguga

SEQ ID NO: 116672 - RNA, 1410 nt, Artificial Sequence; identical to SEQ ID NO: 111769
  derived and/or modified sequence opt2 from neuraminidase__InfluenzaA__AHM98529

SEQ ID NO: 116673 - RNA, 1410 nt, Artificial Sequence; identical to SEQ ID NO: 112513
  derived and/or modified sequence opt2 from neuraminidase__InfluenzaA__AHM98540

SEQ ID NO: 116674 - RNA, 1410 nt, Artificial Sequence
  derived and/or modified sequence opt2 from neuraminidase__InfluenzaA__AHM98562
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaaggccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccuacaccgucggcugguccuggcccgacggcgccgagcuccccuucaccaucgacaaguga

SEQ ID NO: 116675 - RNA, 1410 nt, Artificial Sequence; identical to SEQ ID NO: 116664
  derived and/or modified sequence opt2 from neuraminidase__InfluenzaA__AHM98573

SEQ ID NO: 116676 - RNA, 1410 nt, Artificial Sequence
  derived and/or modified sequence opt2 from neuraminidase__InfluenzaA__AHM98584
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggaucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccuccgcuacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116677 - RNA, 1410 nt, Artificial Sequence; identical to SEQ ID NO: 116664
  derived and/or modified sequence opt2 from neuraminidase__InfluenzaA__AHM98595

SEQ ID NO: 116678 - RNA, 1410 nt, Artificial Sequence; identical to SEQ ID NO: 112221
  derived and/or modified sequence opt2 from neuraminidase__InfluenzaA__AHM98606

SEQ ID NO: 116679 - RNA, 1410 nt, Artificial Sequence
  derived and/or modified sequence opt2 from neuraminidase__InfluenzaA__AHM98617
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggaucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucggcugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116680 - RNA, 1410 nt, Artificial Sequence; identical to SEQ ID NO: 116662
  derived and/or modified sequence opt2 from neuraminidase__InfluenzaA__AHM98628

SEQ ID NO: 116681 - RNA, 1410 nt, Artificial Sequence
  derived and/or modified sequence opt2 from neuraminidase__InfluenzaA__AHM98639
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaucuacgagaacaacaccuggaucaaccagaccuacgucaacaucuccaacaccaacuucgccgccgagcaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116682 - RNA, 1410 nt, Artificial Sequence; identical to SEQ ID NO: 112221
  derived and/or modified sequence opt2 from neuraminidase__InfluenzaA__AHM98650

SEQ ID NO: 116683 - RNA, 1410 nt, Artificial Sequence; identical to SEQ ID NO: 112221
  derived and/or modified sequence opt2 from neuraminidase__InfluenzaA__AHM98661

SEQ ID NO: 116684 - RNA, 1410 nt, Artificial Sequence
  derived and/or modified sequence opt2 from neuraminidase__InfluenzaA__AHM98672
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccagaacgucaucaccuacgagaacaacaccugggucaaccagaccuacgucaacaucuccaacaccaacuucgccgccgagcaguccgucguccccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116685 - RNA, 1410 nt, Artificial Sequence
  derived and/or modified sequence opt2 from neuraminidase__InfluenzaA__AHM98683
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgacgccggccaguccgucgucuccguccgccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcuucaacuggcucaccaucggcaucuccggccccgacaacggcgccgucgccguccucaaguacaacggcaucaucaccgacaccauccgcuccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116686 - RNA, 1410 nt, Artificial Sequence; identical to SEQ ID NO: 112221
  derived and/or modified sequence opt2 from neuraminidase__InfluenzaA__AHM98693

SEQ ID NO: 116687 - RNA, 1410 nt, Artificial Sequence; identical to SEQ ID NO: 114670
  derived and/or modified sequence opt2 from neuraminidase__InfluenzaA__AHM98704

SEQ ID NO: 116688 - RNA, 1410 nt, Artificial Sequence; identical to SEQ ID NO: 114670
  derived and/or modified sequence opt2 from neuraminidase__InfluenzaA__AHM98715

SEQ ID NO: 116689 - RNA, 1410 nt, Artificial Sequence; identical to SEQ ID NO: 112221
  derived and/or modified sequence opt2 from neuraminidase__InfluenzaA__AHM98726

SEQ ID NO: 116690 - RNA, 1410 nt, Artificial Sequence
  derived and/or modified sequence opt2 from neuraminidase__InfluenzaA__AHM98737
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaacuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucgucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacgacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116691 - RNA, 1410 nt, Artificial Sequence; identical to SEQ ID NO: 114670
  derived and/or modified sequence opt2 from neuraminidase__InfluenzaA__AHM98748

SEQ ID NO: 116692 - RNA, 1410 nt, Artificial Sequence; identical to SEQ ID NO: 114670
  derived and/or modified sequence opt2 from neuraminidase__InfluenzaA__AHM98759

SEQ ID NO: 116693 - RNA, 1410 nt, Artificial Sequence
  derived and/or modified sequence opt2 from neuraminidase__InfluenzaA__AHM98770
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgccaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116694 - RNA, 1410 nt, Artificial Sequence
  derived and/or modified sequence opt2 from neuraminidase__InfluenzaA__AHM98781
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccuccgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 116695 - RNA, 1410 nt, Artificial Sequence; identical to SEQ ID NO: 112221
  derived and/or modified sequence opt2 from neuraminidase__InfluenzaA__AHM98801

SEQ ID NO: 116696 - RNA, 1410 nt, Artificial Sequence; identical to SEQ ID NO: 111769
  derived and/or modified sequence opt2 from neuraminidase__InfluenzaA__AHM98812

SEQ ID NO: 116697 - RNA, 1410 nt, Artificial Sequence
  derived and/or modified sequence opt2 from neuraminidase__InfluenzaA__AHM98823
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacaucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116698 - RNA, 1410 nt, Artificial Sequence
  derived and/or modified sequence opt2 from neuraminidase__InfluenzaA__AHM98839
augaaccccaaccagaagaucaucaccaucggcuccgucugcaugaccgucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116699 - RNA, 1410 nt, Artificial Sequence; identical to SEQ ID NO: 111769
  derived and/or modified sequence opt2 from neuraminidase__InfluenzaA__AHM98850

SEQ ID NO: 116700 - RNA, 1410 nt, Artificial Sequence; identical to SEQ ID NO: 111769
  derived and/or modified sequence opt2 from neuraminidase__InfluenzaA__AHM98861

SEQ ID NO: 116701 - RNA, 1410 nt, Artificial Sequence
  derived and/or modified sequence opt2 from neuraminidase__InfluenzaA__AHM98901
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116702 - RNA, 1410 nt, Artificial Sequence; identical to SEQ ID NO: 115358
  derived and/or modified sequence opt2 from neuraminidase__InfluenzaA__AHM98912

SEQ ID NO: 116703 - RNA, 1410 nt, Artificial Sequence; identical to SEQ ID NO: 115358
  derived and/or modified sequence opt2 from neuraminidase__InfluenzaA__AHM98923

SEQ ID NO: 116704 - RNA, 1410 nt, Artificial Sequence; identical to SEQ ID NO: 115358
  derived and/or modified sequence opt2 from neuraminidase__InfluenzaA__AHM98935

SEQ ID NO: 116705 - RNA, 1410 nt, Artificial Sequence; identical to SEQ ID NO: 115358
  derived and/or modified sequence opt2 from neuraminidase__InfluenzaA__AHM98943

SEQ ID NO: 116706 - RNA, 1410 nt, Artificial Sequence; identical to SEQ ID NO: 115358
  derived and/or modified sequence opt2 from neuraminidase__InfluenzaA__AHM98954

SEQ ID NO: 116707 - RNA, 1410 nt, Artificial Sequence; identical to SEQ ID NO: 115358
  derived and/or modified sequence opt2 from neuraminidase__InfluenzaA__AHM98972

SEQ ID NO: 116708 - RNA, 1410 nt, Artificial Sequence; identical to SEQ ID NO: 115358
  derived and/or modified sequence opt2 from neuraminidase__InfluenzaA__AHM98978

SEQ ID NO: 116709 - RNA, 1410 nt, Artificial Sequence; identical to SEQ ID NO: 115358
  derived and/or modified sequence opt2 from neuraminidase__InfluenzaA__AHM98990

SEQ ID NO: 116710 - RNA, 1410 nt, Artificial Sequence; identical to SEQ ID NO: 115358
  derived and/or modified sequence opt2 from neuraminidase__InfluenzaA__AHM99000

SEQ ID NO: 116711 - RNA, 1410 nt, Artificial Sequence; identical to SEQ ID NO: 115358
  derived and/or modified sequence opt2 from neuraminidase__InfluenzaA__AHM99011

SEQ ID NO: 116712 - RNA, 1410 nt, Artificial Sequence; identical to SEQ ID NO: 115334
  derived and/or modified sequence opt2 from neuraminidase__InfluenzaA__AHM99022

SEQ ID NO: 116713 - RNA, 1410 nt, Artificial Sequence; identical to SEQ ID NO: 115334
  derived and/or modified sequence opt2 from neuraminidase__InfluenzaA__AHM99034

SEQ ID NO: 116714 - RNA, 1410 nt, Artificial Sequence; identical to SEQ ID NO: 115334
  derived and/or modified sequence opt2 from neuraminidase__InfluenzaA__AHM99046

SEQ ID NO: 116715 - RNA, 1410 nt, Artificial Sequence; identical to SEQ ID NO: 115334
  derived and/or modified sequence opt2 from neuraminidase__InfluenzaA__AHM99057

SEQ ID NO: 116716 - RNA, 1410 nt, Artificial Sequence; identical to SEQ ID NO: 115334
  derived and/or modified sequence opt2 from neuraminidase__InfluenzaA__AHM99068

SEQ ID NO: 116717 - RNA, 1410 nt, Artificial Sequence; identical to SEQ ID NO: 115358
  derived and/or modified sequence opt2 from neuraminidase__InfluenzaA__AHM99078

SEQ ID NO: 116718 - RNA, 1410 nt, Artificial Sequence
  derived and/or modified sequence opt2 from neuraminidase__InfluenzaA__AHN00720
augaacaccaaccagcgcaucaucaccaucggcaccaucugccucaucgucggcaucaucucccuccuccuccagaucggcaacaucgucucccucuggaucucccacuccauccagaccgaggagaagucccaccccgaggucugcaaccaguccgucaucaccuacgagaacaacaccugggucaaccagaccuacaucaacaucuccaacaccaacaucgccgccggccagggcgucacccccaucauccucgccggcaacuccucccucugccccaucuccggcugggccaucuacuccaaggacaacuccauccgcaucggcuccaagggcgacaucuucgucaugcgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaugaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccaucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucaacuccgagaccgccuccugguccuggcccgacggcgccgaccuccccuucaccaucgacaaguga

SEQ ID NO: 116719 - RNA, 1410 nt, Artificial Sequence
  derived and/or modified sequence opt2 from neuraminidase__InfluenzaA__AHN00767
augaacaccaaccagcgcaucaucaccaucggcaccaucugccucaucgucggcaucaucucccuccuccuccagaucggcaacaucgucucccucuggaucucccacuccauccagaccggcgagaagucccaccccgaggucugcaaccaguccgucaucaccuacgagaacaacaccugggucaaccagaccuacgucaacaucuccaacaccaacaucgccgccggccagggcgucacccccaucauccucgccggcaacuccucccucugccccaucuccggcugggccaucuacuccaaggacaacuccauccgcaucggcuccaagggcgacaucuucgucaugcgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccaucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucaacuccgagaccgccuccugguccuggcccgacggcgccgaccuccccuucaccaucgacaaguga

SEQ ID NO: 116720 - RNA, 1398 nt, Artificial Sequence
  derived and/or modified sequence opt2 from neuraminidase__InfluenzaA__AHN96324
augaaccccaaccagaagauccucugcaccuccgccaccgccaucaucaucggcgccaucgccguccucaucggcaucgccaaccucggccucaacaucggccuccaccucaagcccuccugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucguccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 116721 - RNA, 1410 nt, Artificial Sequence; identical to SEQ ID NO: 112655
  derived and/or modified sequence opt2 from neuraminidase__InfluenzaA__AHN96448

SEQ ID NO: 116722 - RNA, 1410 nt, Artificial Sequence; identical to SEQ ID NO: 113658
  derived and/or modified sequence opt2 from neuraminidase__InfluenzaA__AHN96450

SEQ ID NO: 116723 - RNA, 1410 nt, Artificial Sequence
  derived and/or modified sequence opt2 from neuraminidase__InfluenzaA__AHN96451
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucauguaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116724 - RNA, 1410 nt, Artificial Sequence
  derived and/or modified sequence opt2 from neuraminidase__InfluenzaA__AHN96453
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucgacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116725 - RNA, 1410 nt, Artificial Sequence
  derived and/or modified sequence opt2 from neuraminidase__InfluenzaA__AHZ13526
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaugaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacggcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccaacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 116726 - RNA, 1413 nt, Artificial Sequence; identical to SEQ ID NO: 111717
  derived and/or modified sequence opt2 from neuraminidase__InfluenzaA__AHZ13584

SEQ ID NO: 116727 - RNA, 1410 nt, Artificial Sequence; identical to SEQ ID NO: 114434
  derived and/or modified sequence opt2 from neuraminidase__InfluenzaA__AHZ35575

SEQ ID NO: 116728 - RNA, 1410 nt, Artificial Sequence; identical to SEQ ID NO: 114434
  derived and/or modified sequence opt2 from neuraminidase__InfluenzaA__AHZ35587

SEQ ID NO: 116729 - RNA, 1410 nt, Artificial Sequence
  derived and/or modified sequence opt2 from neuraminidase__InfluenzaA__AHZ35611
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggccgcuccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116730 - RNA, 1410 nt, Artificial Sequence; identical to SEQ ID NO: 114434
  derived and/or modified sequence opt2 from neuraminidase__InfluenzaA__AHZ35623

SEQ ID NO: 116731 - RNA, 1410 nt, Artificial Sequence; identical to SEQ ID NO: 114434
  derived and/or modified sequence opt2 from neuraminidase__InfluenzaA__AHZ35635

SEQ ID NO: 116732 - RNA, 1410 nt, Artificial Sequence
  derived and/or modified sequence opt2 from neuraminidase__InfluenzaA__AHZ35647
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccgacguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116733 - RNA, 1410 nt, Artificial Sequence; identical to SEQ ID NO: 114434
  derived and/or modified sequence opt2 from neuraminidase__InfluenzaA__AHZ35659

SEQ ID NO: 116734 - RNA, 1410 nt, Artificial Sequence; identical to SEQ ID NO: 114434
  derived and/or modified sequence opt2 from neuraminidase__InfluenzaA__AHZ35671

SEQ ID NO: 116735 - RNA, 1410 nt, Artificial Sequence; identical to SEQ ID NO: 114434
  derived and/or modified sequence opt2 from neuraminidase__InfluenzaA__AHZ35683

SEQ ID NO: 116736 - RNA, 1410 nt, Artificial Sequence
  derived and/or modified sequence opt2 from neuraminidase__InfluenzaA__AHZ35695
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacgagcgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaacuccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116737 - RNA, 1410 nt, Artificial Sequence
  derived and/or modified sequence opt2 from neuraminidase__InfluenzaA__AHZ35719
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucacccccaucuga

SEQ ID NO: 116738 - RNA, 1410 nt, Artificial Sequence; identical to SEQ ID NO: 114434
  derived and/or modified sequence opt2 from neuraminidase__InfluenzaA__AHZ35731

SEQ ID NO: 116739 - RNA, 1410 nt, Artificial Sequence; identical to SEQ ID NO: 114434
  derived and/or modified sequence opt2 from neuraminidase__InfluenzaA__AHZ35743

SEQ ID NO: 116740 - RNA, 1410 nt, Artificial Sequence; identical to SEQ ID NO: 114434
  derived and/or modified sequence opt2 from neuraminidase__InfluenzaA__AHZ35755

SEQ ID NO: 116741 - RNA, 1410 nt, Artificial Sequence; identical to SEQ ID NO: 114434
  derived and/or modified sequence opt2 from neuraminidase__InfluenzaA__AHZ35767

SEQ ID NO: 116742 - RNA, 1410 nt, Artificial Sequence; identical to SEQ ID NO: 114434
  derived and/or modified sequence opt2 from neuraminidase__InfluenzaA__AHZ35779

SEQ ID NO: 116743 - RNA, 1410 nt, Artificial Sequence
  derived and/or modified sequence opt2 from neuraminidase__InfluenzaA__AHZ35803
augaaccccaaccagaagaucaucaccaucggcuccgucugcaugaccaucggcauggccaaccucaugcuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaugaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116744 - RNA, 1410 nt, Artificial Sequence
  derived and/or modified sequence opt2 from neuraminidase__InfluenzaA__AHZ35814
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgaccucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116745 - RNA, 1410 nt, Artificial Sequence
  derived and/or modified sequence opt2 from neuraminidase__InfluenzaA__AHZ35837
augaaccccaaccagaagaucaucaccaucggcuccgucugcaugaccaucggcauggccaaccucaugcuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116746 - RNA, 1410 nt, Artificial Sequence; identical to SEQ ID NO: 116745
  derived and/or modified sequence opt2 from neuraminidase__InfluenzaA__AHZ35848

SEQ ID NO: 116747 - RNA, 1410 nt, Artificial Sequence; identical to SEQ ID NO: 116745
  derived and/or modified sequence opt2 from neuraminidase__InfluenzaA__AHZ35859

SEQ ID NO: 116748 - RNA, 1410 nt, Artificial Sequence; identical to SEQ ID NO: 116744
  derived and/or modified sequence opt2 from neuraminidase__InfluenzaA__AHZ35870

SEQ ID NO: 116749 - RNA, 1410 nt, Artificial Sequence; identical to SEQ ID NO: 116744
  derived and/or modified sequence opt2 from neuraminidase__InfluenzaA__AHZ35882

SEQ ID NO: 116750 - RNA, 1410 nt, Artificial Sequence
  derived and/or modified sequence opt2 from neuraminidase__InfluenzaA__AHZ35894
augaaccccaaccagaagaucaucaccaucggcuccgucugcaugaccaucggcauggccaaccucaugcuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcuccggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116751 - RNA, 1410 nt, Artificial Sequence; identical to SEQ ID NO: 116745
  derived and/or modified sequence opt2 from neuraminidase__InfluenzaA__AHZ35905

SEQ ID NO: 116752 - RNA, 1410 nt, Artificial Sequence; identical to SEQ ID NO: 116745
  derived and/or modified sequence opt2 from neuraminidase__InfluenzaA__AHZ35916

SEQ ID NO: 116753 - RNA, 1410 nt, Artificial Sequence; identical to SEQ ID NO: 112470
  derived and/or modified sequence opt2 from neuraminidase__InfluenzaA__AHZ35927

SEQ ID NO: 116754 - RNA, 1410 nt, Artificial Sequence
  derived and/or modified sequence opt2 from neuraminidase__InfluenzaA__AHZ35938
augaaccccaaccagaagaucaucaccaucggcuccgucugcaugaucaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116755 - RNA, 1410 nt, Artificial Sequence; identical to SEQ ID NO: 116744
  derived and/or modified sequence opt2 from neuraminidase__InfluenzaA__AHZ35949

SEQ ID NO: 116756 - RNA, 1410 nt, Artificial Sequence
  derived and/or modified sequence opt2 from neuraminidase__InfluenzaA__AHZ35961
augaaccccaaccagaagaucaucaccaucggcuccgucugcaugaccaucggcauggccaaccucaugcuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 116757 - RNA, 1410 nt, Artificial Sequence; identical to SEQ ID NO: 116745
  derived and/or modified sequence opt2 from neuraminidase__InfluenzaA__AHZ35972

SEQ ID NO: 116758 - RNA, 1410 nt, Artificial Sequence
  derived and/or modified sequence opt2 from neuraminidase__InfluenzaA__AHZ35983
augaaccccaaccagaagaucaccaccaucggcuccgucugcaugaccaucggcauggccaaccucaugcuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116759 - RNA, 1410 nt, Artificial Sequence; identical to SEQ ID NO: 116745
  derived and/or modified sequence opt2 from neuraminidase__InfluenzaA__AHZ35994

SEQ ID NO: 116760 - RNA, 1410 nt, Artificial Sequence; identical to SEQ ID NO: 116745
  derived and/or modified sequence opt2 from neuraminidase__InfluenzaA__AHZ36005

SEQ ID NO: 116761 - RNA, 1410 nt, Artificial Sequence; identical to SEQ ID NO: 116745
  derived and/or modified sequence opt2 from neuraminidase__InfluenzaA__AHZ36016

SEQ ID NO: 116762 - RNA, 1410 nt, Artificial Sequence
  derived and/or modified sequence opt2 from neuraminidase__InfluenzaA__AHZ36027
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaucuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcuucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116763 - RNA, 1410 nt, Artificial Sequence
  derived and/or modified sequence opt2 from neuraminidase__InfluenzaA__AHZ36050
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgccgcaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116764 - RNA, 1410 nt, Artificial Sequence
  derived and/or modified sequence opt2 from neuraminidase__InfluenzaA__AHZ36062
augaaccccaaccagaagaucaucaccaucggcuccgucugcaugaccaucggcauggccaaccucaugcuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucggcugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116765 - RNA, 1410 nt, Artificial Sequence; identical to SEQ ID NO: 116745
  derived and/or modified sequence opt2 from neuraminidase__InfluenzaA__AHZ36084

SEQ ID NO: 116766 - RNA, 1410 nt, Artificial Sequence
  derived and/or modified sequence opt2 from neuraminidase__InfluenzaA__AHZ36095
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaucuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcuucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcggcugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116767 - RNA, 1410 nt, Artificial Sequence; identical to SEQ ID NO: 116745
  derived and/or modified sequence opt2 from neuraminidase__InfluenzaA__AHZ36106

SEQ ID NO: 116768 - RNA, 1410 nt, Artificial Sequence
  derived and/or modified sequence opt2 from neuraminidase__InfluenzaA__AHZ36117
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaucuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugcuccaucggcgagguccccucccccuacaacucccgcuucgaguccgucgccugguccgccuccgccugccacgacggcuucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116769 - RNA, 1410 nt, Artificial Sequence; identical to SEQ ID NO: 116745
  derived and/or modified sequence opt2 from neuraminidase__InfluenzaA__AHZ36128

SEQ ID NO: 116770 - RNA, 1410 nt, Artificial Sequence; identical to SEQ ID NO: 116745
  derived and/or modified sequence opt2 from neuraminidase__InfluenzaA__AHZ36139

SEQ ID NO: 116771 - RNA, 1410 nt, Artificial Sequence; identical to SEQ ID NO: 116763
  derived and/or modified sequence opt2 from neuraminidase__InfluenzaA__AHZ36150

SEQ ID NO: 116772 - RNA, 1410 nt, Artificial Sequence; identical to SEQ ID NO: 116745
  derived and/or modified sequence opt2 from neuraminidase__InfluenzaA__AHZ36161

SEQ ID NO: 116773 - RNA, 1410 nt, Artificial Sequence; identical to SEQ ID NO: 116745
  derived and/or modified sequence opt2 from neuraminidase__InfluenzaA__AHZ36172

SEQ ID NO: 116774 - RNA, 1410 nt, Artificial Sequence
  derived and/or modified sequence opt2 from neuraminidase__InfluenzaA__AHZ36183
augaaccccaaccagaagaucaucaccaucggcuccgucugcaugaccaucggcauggccaaccucaugcuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcauccucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116775 - RNA, 1410 nt, Artificial Sequence; identical to SEQ ID NO: 116744
  derived and/or modified sequence opt2 from neuraminidase__InfluenzaA__AHZ36194

SEQ ID NO: 116776 - RNA, 1410 nt, Artificial Sequence; identical to SEQ ID NO: 116763
  derived and/or modified sequence opt2 from neuraminidase__InfluenzaA__AHZ36206

SEQ ID NO: 116777 - RNA, 1410 nt, Artificial Sequence; identical to SEQ ID NO: 116745
  derived and/or modified sequence opt2 from neuraminidase__InfluenzaA__AHZ36218

SEQ ID NO: 116778 - RNA, 1410 nt, Artificial Sequence; identical to SEQ ID NO: 116763
  derived and/or modified sequence opt2 from neuraminidase__InfluenzaA__AHZ36229

SEQ ID NO: 116779 - RNA, 1410 nt, Artificial Sequence; identical to SEQ ID NO: 116745
  derived and/or modified sequence opt2 from neuraminidase__InfluenzaA__AHZ36241

SEQ ID NO: 116780 - RNA, 1410 nt, Artificial Sequence; identical to SEQ ID NO: 116745
  derived and/or modified sequence opt2 from neuraminidase__InfluenzaA__AHZ36252

SEQ ID NO: 116781 - RNA, 1410 nt, Artificial Sequence; identical to SEQ ID NO: 116745
  derived and/or modified sequence opt2 from neuraminidase__InfluenzaA__AHZ36263

SEQ ID NO: 116782 - RNA, 1410 nt, Artificial Sequence; identical to SEQ ID NO: 114434
  derived and/or modified sequence opt2 from neuraminidase__InfluenzaA__AHZ36274

SEQ ID NO: 116783 - RNA, 1410 nt, Artificial Sequence; identical to SEQ ID NO: 116745
  derived and/or modified sequence opt2 from neuraminidase__InfluenzaA__AHZ36286

SEQ ID NO: 116784 - RNA, 1410 nt, Artificial Sequence
  derived and/or modified sequence opt2 from neuraminidase__InfluenzaA__AHZ36297
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugcccccgccccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcggcgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116785 - RNA, 1410 nt, Artificial Sequence
  derived and/or modified sequence opt2 from neuraminidase__InfluenzaA__AHZ36309
augaaccccaaccagaagaucaucaccaucggcuccgucugcaugaccaucggcauggccaaccucaugcuccagaucggcaacaucaucuccaucuggaucucccacuccauccagcucggcgacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116786 - RNA, 1410 nt, Artificial Sequence; identical to SEQ ID NO: 116745
  derived and/or modified sequence opt2 from neuraminidase__InfluenzaA__AHZ36320

SEQ ID NO: 116787 - RNA, 1410 nt, Artificial Sequence; identical to SEQ ID NO: 116745
  derived and/or modified sequence opt2 from neuraminidase__InfluenzaA__AHZ36331

SEQ ID NO: 116788 - RNA, 1410 nt, Artificial Sequence; identical to SEQ ID NO: 114434
  derived and/or modified sequence opt2 from neuraminidase__InfluenzaA__AHZ36353

SEQ ID NO: 116789 - RNA, 1410 nt, Artificial Sequence
  derived and/or modified sequence opt2 from neuraminidase__InfluenzaA__AHZ36365
augaaccccaaccagaagaucaucaccaucggcuccgucugcaugaccaucggcauggccaaccucaugcuccagaucggcaacaucaucuccaucuggaucucccaccccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116790 - RNA, 1410 nt, Artificial Sequence; identical to SEQ ID NO: 114434
  derived and/or modified sequence opt2 from neuraminidase__InfluenzaA__AHZ36376

SEQ ID NO: 116791 - RNA, 1410 nt, Artificial Sequence; identical to SEQ ID NO: 114434
  derived and/or modified sequence opt2 from neuraminidase__InfluenzaA__AHZ36388

SEQ ID NO: 116792 - RNA, 1410 nt, Artificial Sequence; identical to SEQ ID NO: 114434
  derived and/or modified sequence opt2 from neuraminidase__InfluenzaA__AHZ36400

SEQ ID NO: 116793 - RNA, 1410 nt, Artificial Sequence; identical to SEQ ID NO: 114434
  derived and/or modified sequence opt2 from neuraminidase__InfluenzaA__AHZ36412

SEQ ID NO: 116794 - RNA, 1410 nt, Artificial Sequence; identical to SEQ ID NO: 114434
  derived and/or modified sequence opt2 from neuraminidase__InfluenzaA__AHZ36424

SEQ ID NO: 116795 - RNA, 1410 nt, Artificial Sequence; identical to SEQ ID NO: 114434
  derived and/or modified sequence opt2 from neuraminidase__InfluenzaA__AHZ36436

SEQ ID NO: 116796 - RNA, 1410 nt, Artificial Sequence
  derived and/or modified sequence opt2 from neuraminidase__InfluenzaA__AHZ36448
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116797 - RNA, 1410 nt, Artificial Sequence; identical to SEQ ID NO: 114434
  derived and/or modified sequence opt2 from neuraminidase__InfluenzaA__AHZ36460

SEQ ID NO: 116798 - RNA, 1410 nt, Artificial Sequence; identical to SEQ ID NO: 114434
  derived and/or modified sequence opt2 from neuraminidase__InfluenzaA__AHZ36472

SEQ ID NO: 116799 - RNA, 1410 nt, Artificial Sequence; identical to SEQ ID NO: 114434
  derived and/or modified sequence opt2 from neuraminidase__InfluenzaA__AHZ36484

SEQ ID NO: 116800 - RNA, 1410 nt, Artificial Sequence; identical to SEQ ID NO: 114434
  derived and/or modified sequence opt2 from neuraminidase__InfluenzaA__AHZ36496

SEQ ID NO: 116801 - RNA, 1410 nt, Artificial Sequence; identical to SEQ ID NO: 114434
  derived and/or modified sequence opt2 from neuraminidase__InfluenzaA__AHZ36508

SEQ ID NO: 116802 - RNA, 1410 nt, Artificial Sequence; identical to SEQ ID NO: 114434
  derived and/or modified sequence opt2 from neuraminidase__InfluenzaA__AHZ36520

SEQ ID NO: 116803 - RNA, 1410 nt, Artificial Sequence
  derived and/or modified sequence opt2 from neuraminidase__InfluenzaA__AHZ36532
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaccugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116804 - RNA, 1410 nt, Artificial Sequence; identical to SEQ ID NO: 114434
  derived and/or modified sequence opt2 from neuraminidase__InfluenzaA__AHZ36544

SEQ ID NO: 116805 - RNA, 1410 nt, Artificial Sequence; identical to SEQ ID NO: 114434
  derived and/or modified sequence opt2 from neuraminidase__InfluenzaA__AHZ36556

SEQ ID NO: 116806 - RNA, 1410 nt, Artificial Sequence; identical to SEQ ID NO: 114434
  derived and/or modified sequence opt2 from neuraminidase__InfluenzaA__AHZ36568

SEQ ID NO: 116807 - RNA, 1410 nt, Artificial Sequence; identical to SEQ ID NO: 114434
  derived and/or modified sequence opt2 from neuraminidase__InfluenzaA__AHZ36580

SEQ ID NO: 116808 - RNA, 1410 nt, Artificial Sequence; identical to SEQ ID NO: 114434
  derived and/or modified sequence opt2 from neuraminidase__InfluenzaA__AHZ36592

SEQ ID NO: 116809 - RNA, 1410 nt, Artificial Sequence; identical to SEQ ID NO: 114434
  derived and/or modified sequence opt2 from neuraminidase__InfluenzaA__AHZ36604

SEQ ID NO: 116810 - RNA, 1410 nt, Artificial Sequence; identical to SEQ ID NO: 114434
  derived and/or modified sequence opt2 from neuraminidase__InfluenzaA__AHZ36616

SEQ ID NO: 116811 - RNA, 1410 nt, Artificial Sequence
  derived and/or modified sequence opt2 from neuraminidase__InfluenzaA__AHZ36628
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116812 - RNA, 1410 nt, Artificial Sequence
  derived and/or modified sequence opt2 from neuraminidase__InfluenzaA__AHZ36640
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116813 - RNA, 1410 nt, Artificial Sequence; identical to SEQ ID NO: 114434
  derived and/or modified sequence opt2 from neuraminidase__InfluenzaA__AHZ36652

SEQ ID NO: 116814 - RNA, 1410 nt, Artificial Sequence; identical to SEQ ID NO: 113658
  derived and/or modified sequence opt2 from neuraminidase__InfluenzaA__AHZ36664

SEQ ID NO: 116815 - RNA, 1410 nt, Artificial Sequence; identical to SEQ ID NO: 113658
  derived and/or modified sequence opt2 from neuraminidase__InfluenzaA__AHZ36676

SEQ ID NO: 116816 - RNA, 1410 nt, Artificial Sequence; identical to SEQ ID NO: 113658
  derived and/or modified sequence opt2 from neuraminidase__InfluenzaA__AHZ36688

SEQ ID NO: 116817 - RNA, 1398 nt, Artificial Sequence; identical to SEQ ID NO: 114966
  derived and/or modified sequence opt2 from neuraminidase__InfluenzaA__AHZ39689

SEQ ID NO: 116818 - RNA, 1398 nt, Artificial Sequence; identical to SEQ ID NO: 114966
  derived and/or modified sequence opt2 from neuraminidase__InfluenzaA__AHZ39713

SEQ ID NO: 116819 - RNA, 1398 nt, Artificial Sequence; identical to SEQ ID NO: 114966
  derived and/or modified sequence opt2 from neuraminidase__InfluenzaA__AHZ39725

SEQ ID NO: 116820 - RNA, 1398 nt, Artificial Sequence; identical to SEQ ID NO: 114966
  derived and/or modified sequence opt2 from neuraminidase__InfluenzaA__AHZ39737

SEQ ID NO: 116821 - RNA, 1398 nt, Artificial Sequence
  derived and/or modified sequence opt2 from neuraminidase__InfluenzaA__AHZ39749
augaaccccaaccagaagauccucugcaucuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 116822 - RNA, 1398 nt, Artificial Sequence; identical to SEQ ID NO: 116821
  derived and/or modified sequence opt2 from neuraminidase__InfluenzaA__AHZ39761

SEQ ID NO: 116823 - RNA, 1398 nt, Artificial Sequence; identical to SEQ ID NO: 114966
  derived and/or modified sequence opt2 from neuraminidase__InfluenzaA__AHZ39773

SEQ ID NO: 116824 - RNA, 1398 nt, Artificial Sequence; identical to SEQ ID NO: 114966
  derived and/or modified sequence opt2 from neuraminidase__InfluenzaA__AHZ39785

SEQ ID NO: 116825 - RNA, 1410 nt, Artificial Sequence
  derived and/or modified sequence opt2 from neuraminidase__InfluenzaA__AHZ39797
augaaccccaaccagaagaucaucaccaucggcuccgucucccucaccaucuccaccgucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaguccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116826 - RNA, 1410 nt, Artificial Sequence
  derived and/or modified sequence opt2 from neuraminidase__InfluenzaA__AHZ39821
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgccgcaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaccuga

SEQ ID NO: 116827 - RNA, 1410 nt, Artificial Sequence; identical to SEQ ID NO: 114901
  derived and/or modified sequence opt2 from neuraminidase__InfluenzaA__AHZ39833

SEQ ID NO: 116828 - RNA, 1410 nt, Artificial Sequence; identical to SEQ ID NO: 113658
  derived and/or modified sequence opt2 from neuraminidase__InfluenzaA__AHZ39844

SEQ ID NO: 116829 - RNA, 1410 nt, Artificial Sequence
  derived and/or modified sequence opt2 from neuraminidase__InfluenzaA__AHZ39856
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccccaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116830 - RNA, 1410 nt, Artificial Sequence; identical to SEQ ID NO: 113658
  derived and/or modified sequence opt2 from neuraminidase__InfluenzaA__AHZ39868

SEQ ID NO: 116831 - RNA, 1410 nt, Artificial Sequence
  derived and/or modified sequence opt2 from neuraminidase__InfluenzaA__AHZ39892
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116832 - RNA, 1410 nt, Artificial Sequence; identical to SEQ ID NO: 114866
  derived and/or modified sequence opt2 from neuraminidase__InfluenzaA__AHZ39904

SEQ ID NO: 116833 - RNA, 1410 nt, Artificial Sequence; identical to SEQ ID NO: 114866
  derived and/or modified sequence opt2 from neuraminidase__InfluenzaA__AHZ39916

SEQ ID NO: 116834 - RNA, 1410 nt, Artificial Sequence; identical to SEQ ID NO: 113658
  derived and/or modified sequence opt2 from neuraminidase__InfluenzaA__AHZ39928

SEQ ID NO: 116835 - RNA, 1410 nt, Artificial Sequence
  derived and/or modified sequence opt2 from neuraminidase__InfluenzaA__AHZ39940
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116836 - RNA, 1410 nt, Artificial Sequence; identical to SEQ ID NO: 113658
  derived and/or modified sequence opt2 from neuraminidase__InfluenzaA__AHZ39952

SEQ ID NO: 116837 - RNA, 1410 nt, Artificial Sequence; identical to SEQ ID NO: 113658
  derived and/or modified sequence opt2 from neuraminidase__InfluenzaA__AHZ39976

SEQ ID NO: 116838 - RNA, 1410 nt, Artificial Sequence
  derived and/or modified sequence opt2 from neuraminidase__InfluenzaA__AHZ39988
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccacccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116839 - RNA, 1410 nt, Artificial Sequence; identical to SEQ ID NO: 113658
  derived and/or modified sequence opt2 from neuraminidase__InfluenzaA__AHZ40000

SEQ ID NO: 116840 - RNA, 1410 nt, Artificial Sequence; identical to SEQ ID NO: 113658
  derived and/or modified sequence opt2 from neuraminidase__InfluenzaA__AHZ40012

SEQ ID NO: 116841 - RNA, 1410 nt, Artificial Sequence
  derived and/or modified sequence opt2 from neuraminidase__InfluenzaA__AHZ40024
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuucgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116842 - RNA, 1410 nt, Artificial Sequence; identical to SEQ ID NO: 113658
  derived and/or modified sequence opt2 from neuraminidase__InfluenzaA__AHZ40036

SEQ ID NO: 116843 - RNA, 1410 nt, Artificial Sequence; identical to SEQ ID NO: 114869
  derived and/or modified sequence opt2 from neuraminidase__InfluenzaA__AHZ40048

SEQ ID NO: 116844 - RNA, 1410 nt, Artificial Sequence; identical to SEQ ID NO: 113658
  derived and/or modified sequence opt2 from neuraminidase__InfluenzaA__AHZ40063

SEQ ID NO: 116845 - RNA, 1410 nt, Artificial Sequence
  derived and/or modified sequence opt2 from neuraminidase__InfluenzaA__AHZ40075
augaaccccaaccagaagaucaucaccaucggcuccgucucccucaccaucuccaccgucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaacuccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116846 - RNA, 1410 nt, Artificial Sequence; identical to SEQ ID NO: 113658
  derived and/or modified sequence opt2 from neuraminidase__InfluenzaA__AHZ40087

SEQ ID NO: 116847 - RNA, 1410 nt, Artificial Sequence; identical to SEQ ID NO: 114869
  derived and/or modified sequence opt2 from neuraminidase__InfluenzaA__AHZ40099

SEQ ID NO: 116848 - RNA, 1410 nt, Artificial Sequence
  derived and/or modified sequence opt2 from neuraminidase__InfluenzaA__AHZ40111
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116849 - RNA, 1410 nt, Artificial Sequence
  derived and/or modified sequence opt2 from neuraminidase__InfluenzaA__AHZ40123
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaccgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacacccgcacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116850 - RNA, 1410 nt, Artificial Sequence; identical to SEQ ID NO: 113658
  derived and/or modified sequence opt2 from neuraminidase__InfluenzaA__AHZ40133

SEQ ID NO: 116851 - RNA, 1410 nt, Artificial Sequence; identical to SEQ ID NO: 114876
  derived and/or modified sequence opt2 from neuraminidase__InfluenzaA__AHZ40145

SEQ ID NO: 116852 - RNA, 1410 nt, Artificial Sequence
  derived and/or modified sequence opt2 from neuraminidase__InfluenzaA__AHZ40157
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagcucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgccguccucuggaccuccaacuccaucgucgucuucugcggcaccuccggcaccuacggcaccggcuccuggcccgacggcgccgaccucaaccucaugcccaucuga

SEQ ID NO: 116853 - RNA, 1410 nt, Artificial Sequence
  derived and/or modified sequence opt2 from neuraminidase__InfluenzaA__AHZ40169
augaaccccaaccagaagaucaucaccaucggcuccgucugcaugaccaucggcauggccaaccucauccuccagaucggcaacaucaucuccaucuggaucucccacuccauccagcucgagaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116854 - RNA, 1410 nt, Artificial Sequence
  derived and/or modified sequence opt2 from neuraminidase__InfluenzaA__AHZ40180
augaaccccaaccagaagaucaucaccaucggcuccgucucccucaccaucuccaccaucugcuucuucaugcagaucaccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116855 - RNA, 1410 nt, Artificial Sequence; identical to SEQ ID NO: 114522
  derived and/or modified sequence opt2 from neuraminidase__InfluenzaA__AHZ40192

SEQ ID NO: 116856 - RNA, 1410 nt, Artificial Sequence; identical to SEQ ID NO: 113658
  derived and/or modified sequence opt2 from neuraminidase__InfluenzaA__AHZ40204

SEQ ID NO: 116857 - RNA, 1410 nt, Artificial Sequence; identical to SEQ ID NO: 113658
  derived and/or modified sequence opt2 from neuraminidase__InfluenzaA__AHZ40216

SEQ ID NO: 116858 - RNA, 1410 nt, Artificial Sequence; identical to SEQ ID NO: 114887
  derived and/or modified sequence opt2 from neuraminidase__InfluenzaA__AHZ40228

SEQ ID NO: 116859 - RNA, 1410 nt, Artificial Sequence
  derived and/or modified sequence opt2 from neuraminidase__InfluenzaA__AHZ40240
augaaccccaaccagaagaucaucaccaucggcuccgucucccucaccaucuccaccaucugcuuccucaugcagaucgccauccucaucaccaccgccacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccgcuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116860 - RNA, 1410 nt, Artificial Sequence
  derived and/or modified sequence opt2 from neuraminidase__InfluenzaA__AHZ40252
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgaggacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116861 - RNA, 1410 nt, Artificial Sequence; identical to SEQ ID NO: 116606
  derived and/or modified sequence opt2 from neuraminidase__InfluenzaA__AHZ40264

SEQ ID NO: 116862 - RNA, 1410 nt, Artificial Sequence; identical to SEQ ID NO: 113658
  derived and/or modified sequence opt2 from neuraminidase__InfluenzaA__AHZ40276

SEQ ID NO: 116863 - RNA, 1410 nt, Artificial Sequence
  derived and/or modified sequence opt2 from neuraminidase__InfluenzaA__AHZ40288
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucaucuccugguccaaggacauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116864 - RNA, 1410 nt, Artificial Sequence
  derived and/or modified sequence opt2 from neuraminidase__InfluenzaA__AHZ40312
augaaccccaaccagaagaucaucaccaucggcuccgucucccucaccaucuccaccaucugcuucuucaugcagaucgccauccucaucaccaccgucacccuccacuucaagcaguacgaguucaacuacccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccgucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116865 - RNA, 1410 nt, Artificial Sequence; identical to SEQ ID NO: 113658
  derived and/or modified sequence opt2 from neuraminidase__InfluenzaA__AHZ40324

SEQ ID NO: 116866 - RNA, 1410 nt, Artificial Sequence; identical to SEQ ID NO: 113658
  derived and/or modified sequence opt2 from neuraminidase__InfluenzaA__AHZ40336

SEQ ID NO: 116867 - RNA, 1410 nt, Artificial Sequence; identical to SEQ ID NO: 116841
  derived and/or modified sequence opt2 from neuraminidase__InfluenzaA__AHZ40348

SEQ ID NO: 116868 - RNA, 1410 nt, Artificial Sequence; identical to SEQ ID NO: 114866
  derived and/or modified sequence opt2 from neuraminidase__InfluenzaA__AHZ40360

SEQ ID NO: 116869 - RNA, 1410 nt, Artificial Sequence
  derived and/or modified sequence opt2 from neuraminidase__InfluenzaA__AHZ40372
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116870 - RNA, 1410 nt, Artificial Sequence; identical to SEQ ID NO: 114522
  derived and/or modified sequence opt2 from neuraminidase__InfluenzaA__AHZ40384

SEQ ID NO: 116871 - RNA, 1410 nt, Artificial Sequence; identical to SEQ ID NO: 113658
  derived and/or modified sequence opt2 from neuraminidase__InfluenzaA__AHZ40396

SEQ ID NO: 116872 - RNA, 1410 nt, Artificial Sequence; identical to SEQ ID NO: 113658
  derived and/or modified sequence opt2 from neuraminidase__InfluenzaA__AHZ40408

SEQ ID NO: 116873 - RNA, 1410 nt, Artificial Sequence; identical to SEQ ID NO: 113658
  derived and/or modified sequence opt2 from neuraminidase__InfluenzaA__AHZ40420

SEQ ID NO: 116874 - RNA, 1410 nt, Artificial Sequence
  derived and/or modified sequence opt2 from neuraminidase__InfluenzaA__AHZ40432
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucaucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116875 - RNA, 1410 nt, Artificial Sequence; identical to SEQ ID NO: 113658
  derived and/or modified sequence opt2 from neuraminidase__InfluenzaA__AHZ40444

SEQ ID NO: 116876 - RNA, 1410 nt, Artificial Sequence
  derived and/or modified sequence opt2 from neuraminidase__InfluenzaA__AHZ40456
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116877 - RNA, 1410 nt, Artificial Sequence
  derived and/or modified sequence opt2 from neuraminidase__InfluenzaA__AHZ40468
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcaacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116878 - RNA, 1410 nt, Artificial Sequence; identical to SEQ ID NO: 114866
  derived and/or modified sequence opt2 from neuraminidase__InfluenzaA__AHZ40480

SEQ ID NO: 116879 - RNA, 1410 nt, Artificial Sequence; identical to SEQ ID NO: 116304
  derived and/or modified sequence opt2 from neuraminidase__InfluenzaA__AHZ40492

SEQ ID NO: 116880 - RNA, 1410 nt, Artificial Sequence; identical to SEQ ID NO: 113658
  derived and/or modified sequence opt2 from neuraminidase__InfluenzaA__AHZ40503

SEQ ID NO: 116881 - RNA, 1410 nt, Artificial Sequence; identical to SEQ ID NO: 113658
  derived and/or modified sequence opt2 from neuraminidase__InfluenzaA__AHZ40515

SEQ ID NO: 116882 - RNA, 1410 nt, Artificial Sequence
  derived and/or modified sequence opt2 from neuraminidase__InfluenzaA__AHZ40527
augaaccccaaccagaagaucaucaccaucggcuccgucucccucaccaucuccaccaugugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116883 - RNA, 1410 nt, Artificial Sequence
  derived and/or modified sequence opt2 from neuraminidase__InfluenzaA__AHZ40539
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucgucaacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116884 - RNA, 1410 nt, Artificial Sequence; identical to SEQ ID NO: 113658
  derived and/or modified sequence opt2 from neuraminidase__InfluenzaA__AHZ40551

SEQ ID NO: 116885 - RNA, 1410 nt, Artificial Sequence
  derived and/or modified sequence opt2 from neuraminidase__InfluenzaA__AHZ40563
augaaccccaaccagaagaucaucaccaucggcuccgucucccucaccaucuccaccgucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaacuccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116886 - RNA, 1410 nt, Artificial Sequence
  derived and/or modified sequence opt2 from neuraminidase__InfluenzaA__AHZ40575
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucucccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116887 - RNA, 1410 nt, Artificial Sequence; identical to SEQ ID NO: 116605
  derived and/or modified sequence opt2 from neuraminidase__InfluenzaA__AHZ40586

SEQ ID NO: 116888 - RNA, 1410 nt, Artificial Sequence
  derived and/or modified sequence opt2 from neuraminidase__InfluenzaA__AHZ40598
augaaccccaaccagaagaucaucaccaucggcuccgucugcaugaccaucggcauggccaaccucauccuccagaucggcaacaucaucuccaucuggaucucccacuccauccaggucggcaaccagucccagaucgagaccugcaaccaguccgucaucaccuacgagaacaacaccugggucaaccagaccuacgucaacaucuccaacaccaacuucgccgccggccagcccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacgacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 116889 - RNA, 1410 nt, Artificial Sequence; identical to SEQ ID NO: 113658
  derived and/or modified sequence opt2 from neuraminidase__InfluenzaA__AHZ40609

SEQ ID NO: 116890 - RNA, 1410 nt, Artificial Sequence; identical to SEQ ID NO: 114887
  derived and/or modified sequence opt2 from neuraminidase__InfluenzaA__AHZ40629

SEQ ID NO: 116891 - RNA, 1410 nt, Artificial Sequence; identical to SEQ ID NO: 114869
  derived and/or modified sequence opt2 from neuraminidase__InfluenzaA__AHZ40641

SEQ ID NO: 116892 - RNA, 1410 nt, Artificial Sequence
  derived and/or modified sequence opt2 from neuraminidase__InfluenzaA__AHZ40653
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccggcuaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116893 - RNA, 1410 nt, Artificial Sequence; identical to SEQ ID NO: 114887
  derived and/or modified sequence opt2 from neuraminidase__InfluenzaA__AHZ40665

SEQ ID NO: 116894 - RNA, 1410 nt, Artificial Sequence; identical to SEQ ID NO: 114887
  derived and/or modified sequence opt2 from neuraminidase__InfluenzaA__AHZ40677

SEQ ID NO: 116895 - RNA, 1410 nt, Artificial Sequence; identical to SEQ ID NO: 113658
  derived and/or modified sequence opt2 from neuraminidase__InfluenzaA__AHZ40689

SEQ ID NO: 116896 - RNA, 1410 nt, Artificial Sequence
  derived and/or modified sequence opt2 from neuraminidase__InfluenzaA__AHZ40713
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgacaaguccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116897 - RNA, 1410 nt, Artificial Sequence
  derived and/or modified sequence opt2 from neuraminidase__InfluenzaA__AHZ40725
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccggcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116898 - RNA, 1410 nt, Artificial Sequence; identical to SEQ ID NO: 114876
  derived and/or modified sequence opt2 from neuraminidase__InfluenzaA__AHZ40737

SEQ ID NO: 116899 - RNA, 1410 nt, Artificial Sequence
  derived and/or modified sequence opt2 from neuraminidase__InfluenzaA__AHZ40749
augaaccccaaccagaagaucaucaccaucggcuccgucucccucaccaucuccaccaucugccucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggccccuggcccgacggcgccgaccucaaccucaugcccaucuga

SEQ ID NO: 116900 - RNA, 1410 nt, Artificial Sequence
  derived and/or modified sequence opt2 from neuraminidase__InfluenzaA__AHZ40761
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagcucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaagaaggagaccgccguccucuggaccuccaacuccaucgucgucuucugcggcaccuccggcaccuacggcaccggcuccuggcccgacggcgccgaccucaaccucaugcccaucuga

SEQ ID NO: 116901 - RNA, 1410 nt, Artificial Sequence; identical to SEQ ID NO: 113658
  derived and/or modified sequence opt2 from neuraminidase__InfluenzaA__AHZ40773

SEQ ID NO: 116902 - RNA, 1410 nt, Artificial Sequence; identical to SEQ ID NO: 108240
  derived and/or modified sequence opt2 from neuraminidase__InfluenzaA__AHZ40785

SEQ ID NO: 116903 - RNA, 1410 nt, Artificial Sequence; identical to SEQ ID NO: 108240
  derived and/or modified sequence opt2 from neuraminidase__InfluenzaA__AHZ40796

SEQ ID NO: 116904 - RNA, 1410 nt, Artificial Sequence; identical to SEQ ID NO: 108240
  derived and/or modified sequence opt2 from neuraminidase__InfluenzaA__AHZ40807

SEQ ID NO: 116905 - RNA, 1410 nt, Artificial Sequence; identical to SEQ ID NO: 108240
  derived and/or modified sequence opt2 from neuraminidase__InfluenzaA__AHZ40818

SEQ ID NO: 116906 - RNA, 1410 nt, Artificial Sequence; identical to SEQ ID NO: 108240
  derived and/or modified sequence opt2 from neuraminidase__InfluenzaA__AHZ40829

SEQ ID NO: 116907 - RNA, 1410 nt, Artificial Sequence; identical to SEQ ID NO: 108240
  derived and/or modified sequence opt2 from neuraminidase__InfluenzaA__AHZ40840

SEQ ID NO: 116908 - RNA, 1410 nt, Artificial Sequence; identical to SEQ ID NO: 108240
  derived and/or modified sequence opt2 from neuraminidase__InfluenzaA__AHZ40851

SEQ ID NO: 116909 - RNA, 1410 nt, Artificial Sequence; identical to SEQ ID NO: 108240
  derived and/or modified sequence opt2 from neuraminidase__InfluenzaA__AHZ40862

SEQ ID NO: 116910 - RNA, 1410 nt, Artificial Sequence; identical to SEQ ID NO: 108240
  derived and/or modified sequence opt2 from neuraminidase__InfluenzaA__AHZ40873

SEQ ID NO: 116911 - RNA, 1410 nt, Artificial Sequence; identical to SEQ ID NO: 108240
  derived and/or modified sequence opt2 from neuraminidase__InfluenzaA__AHZ40884

SEQ ID NO: 116912 - RNA, 1410 nt, Artificial Sequence; identical to SEQ ID NO: 108240
  derived and/or modified sequence opt2 from neuraminidase__InfluenzaA__AHZ40895

SEQ ID NO: 116913 - RNA, 1410 nt, Artificial Sequence; identical to SEQ ID NO: 108240
  derived and/or modified sequence opt2 from neuraminidase__InfluenzaA__AHZ40906

SEQ ID NO: 116914 - RNA, 1410 nt, Artificial Sequence; identical to SEQ ID NO: 108240
  derived and/or modified sequence opt2 from neuraminidase__InfluenzaA__AHZ40917

SEQ ID NO: 116915 - RNA, 1410 nt, Artificial Sequence; identical to SEQ ID NO: 108240
  derived and/or modified sequence opt2 from neuraminidase__InfluenzaA__AHZ40928

SEQ ID NO: 116916 - RNA, 1410 nt, Artificial Sequence; identical to SEQ ID NO: 108240
  derived and/or modified sequence opt2 from neuraminidase__InfluenzaA__AHZ40939

SEQ ID NO: 116917 - RNA, 1410 nt, Artificial Sequence; identical to SEQ ID NO: 108240
  derived and/or modified sequence opt2 from neuraminidase__InfluenzaA__AHZ40950

SEQ ID NO: 116918 - RNA, 1410 nt, Artificial Sequence; identical to SEQ ID NO: 108240
  derived and/or modified sequence opt2 from neuraminidase__InfluenzaA__AHZ40961

SEQ ID NO: 116919 - RNA, 1410 nt, Artificial Sequence; identical to SEQ ID NO: 108240
  derived and/or modified sequence opt2 from neuraminidase__InfluenzaA__AHZ40972

SEQ ID NO: 116920 - RNA, 1410 nt, Artificial Sequence; identical to SEQ ID NO: 108240
  derived and/or modified sequence opt2 from neuraminidase__InfluenzaA__AHZ40983

SEQ ID NO: 116921 - RNA, 1410 nt, Artificial Sequence; identical to SEQ ID NO: 108240
  derived and/or modified sequence opt2 from neuraminidase__InfluenzaA__AHZ40994

SEQ ID NO: 116922 - RNA, 1410 nt, Artificial Sequence; identical to SEQ ID NO: 108240
  derived and/or modified sequence opt2 from neuraminidase__InfluenzaA__AHZ41005

SEQ ID NO: 116923 - RNA, 1410 nt, Artificial Sequence; identical to SEQ ID NO: 108240
  derived and/or modified sequence opt2 from neuraminidase__InfluenzaA__AHZ41016

SEQ ID NO: 116924 - RNA, 1410 nt, Artificial Sequence; identical to SEQ ID NO: 108240
  derived and/or modified sequence opt2 from neuraminidase__InfluenzaA__AHZ41027

SEQ ID NO: 116925 - RNA, 1410 nt, Artificial Sequence; identical to SEQ ID NO: 108240
  derived and/or modified sequence opt2 from neuraminidase__InfluenzaA__AHZ41049

SEQ ID NO: 116926 - RNA, 1410 nt, Artificial Sequence; identical to SEQ ID NO: 108240
  derived and/or modified sequence opt2 from neuraminidase__InfluenzaA__AHZ41060

SEQ ID NO: 116927 - RNA, 1410 nt, Artificial Sequence; identical to SEQ ID NO: 108240
  derived and/or modified sequence opt2 from neuraminidase__InfluenzaA__AHZ41071

SEQ ID NO: 116928 - RNA, 1410 nt, Artificial Sequence; identical to SEQ ID NO: 108240
  derived and/or modified sequence opt2 from neuraminidase__InfluenzaA__AHZ41082

SEQ ID NO: 116929 - RNA, 1410 nt, Artificial Sequence; identical to SEQ ID NO: 108240
  derived and/or modified sequence opt2 from neuraminidase__InfluenzaA__AHZ41093

SEQ ID NO: 116930 - RNA, 1410 nt, Artificial Sequence; identical to SEQ ID NO: 108240
  derived and/or modified sequence opt2 from neuraminidase__InfluenzaA__AHZ41104

SEQ ID NO: 116931 - RNA, 1410 nt, Artificial Sequence; identical to SEQ ID NO: 108240
  derived and/or modified sequence opt2 from neuraminidase__InfluenzaA__AHZ41115

SEQ ID NO: 116932 - RNA, 1410 nt, Artificial Sequence; identical to SEQ ID NO: 108240
  derived and/or modified sequence opt2 from neuraminidase__InfluenzaA__AHZ41126

SEQ ID NO: 116933 - RNA, 1410 nt, Artificial Sequence; identical to SEQ ID NO: 108240
  derived and/or modified sequence opt2 from neuraminidase__InfluenzaA__AHZ41137

SEQ ID NO: 116934 - RNA, 1410 nt, Artificial Sequence; identical to SEQ ID NO: 108240
  derived and/or modified sequence opt2 from neuraminidase__InfluenzaA__AHZ41148

SEQ ID NO: 116935 - RNA, 1410 nt, Artificial Sequence; identical to SEQ ID NO: 108240
  derived and/or modified sequence opt2 from neuraminidase__InfluenzaA__AHZ41159

SEQ ID NO: 116936 - RNA, 1410 nt, Artificial Sequence; identical to SEQ ID NO: 108240
  derived and/or modified sequence opt2 from neuraminidase__InfluenzaA__AHZ41170

SEQ ID NO: 116937 - RNA, 1410 nt, Artificial Sequence; identical to SEQ ID NO: 108240
  derived and/or modified sequence opt2 from neuraminidase__InfluenzaA__AHZ41181

SEQ ID NO: 116938 - RNA, 1410 nt, Artificial Sequence; identical to SEQ ID NO: 108240
  derived and/or modified sequence opt2 from neuraminidase__InfluenzaA__AHZ41205

SEQ ID NO: 116939 - RNA, 1410 nt, Artificial Sequence; identical to SEQ ID NO: 108240
  derived and/or modified sequence opt2 from neuraminidase__InfluenzaA__AHZ41251

SEQ ID NO: 116940 - RNA, 1410 nt, Artificial Sequence; identical to SEQ ID NO: 108240
  derived and/or modified sequence opt2 from neuraminidase__InfluenzaA__AHZ41266

SEQ ID NO: 116941 - RNA, 1410 nt, Artificial Sequence; identical to SEQ ID NO: 108240
  derived and/or modified sequence opt2 from neuraminidase__InfluenzaA__AHZ41284

SEQ ID NO: 116942 - RNA, 1410 nt, Artificial Sequence; identical to SEQ ID NO: 108240
  derived and/or modified sequence opt2 from neuraminidase__InfluenzaA__AHZ41295

SEQ ID NO: 116943 - RNA, 1410 nt, Artificial Sequence; identical to SEQ ID NO: 108240
  derived and/or modified sequence opt2 from neuraminidase__InfluenzaA__AHZ41306

SEQ ID NO: 116944 - RNA, 1410 nt, Artificial Sequence; identical to SEQ ID NO: 108240
  derived and/or modified sequence opt2 from neuraminidase__InfluenzaA__AHZ41317

SEQ ID NO: 116945 - RNA, 1410 nt, Artificial Sequence; identical to SEQ ID NO: 108240
  derived and/or modified sequence opt2 from neuraminidase__InfluenzaA__AHZ41328

SEQ ID NO: 116946 - RNA, 1410 nt, Artificial Sequence; identical to SEQ ID NO: 108240
  derived and/or modified sequence opt2 from neuraminidase__InfluenzaA__AHZ41339

SEQ ID NO: 116947 - RNA, 1410 nt, Artificial Sequence; identical to SEQ ID NO: 108240
  derived and/or modified sequence opt2 from neuraminidase__InfluenzaA__AHZ41350

SEQ ID NO: 116948 - RNA, 1410 nt, Artificial Sequence; identical to SEQ ID NO: 108240
  derived and/or modified sequence opt2 from neuraminidase__InfluenzaA__AHZ41369

SEQ ID NO: 116949 - RNA, 1410 nt, Artificial Sequence; identical to SEQ ID NO: 108240
  derived and/or modified sequence opt2 from neuraminidase__InfluenzaA__AHZ41380

SEQ ID NO: 116950 - RNA, 1410 nt, Artificial Sequence; identical to SEQ ID NO: 108240
  derived and/or modified sequence opt2 from neuraminidase__InfluenzaA__AHZ41391

SEQ ID NO: 116951 - RNA, 1410 nt, Artificial Sequence; identical to SEQ ID NO: 108240
  derived and/or modified sequence opt2 from neuraminidase__InfluenzaA__AHZ41402

SEQ ID NO: 116952 - RNA, 1410 nt, Artificial Sequence; identical to SEQ ID NO: 108240
  derived and/or modified sequence opt2 from neuraminidase__InfluenzaA__AHZ41413

SEQ ID NO: 116953 - RNA, 1410 nt, Artificial Sequence; identical to SEQ ID NO: 108240
  derived and/or modified sequence opt2 from neuraminidase__InfluenzaA__AHZ41444

SEQ ID NO: 116954 - RNA, 1410 nt, Artificial Sequence; identical to SEQ ID NO: 108240
  derived and/or modified sequence opt2 from neuraminidase__InfluenzaA__AHZ41455

SEQ ID NO: 116955 - RNA, 1410 nt, Artificial Sequence; identical to SEQ ID NO: 108240
  derived and/or modified sequence opt2 from neuraminidase__InfluenzaA__AHZ41476

SEQ ID NO: 116956 - RNA, 1410 nt, Artificial Sequence; identical to SEQ ID NO: 108240
  derived and/or modified sequence opt2 from neuraminidase__InfluenzaA__AHZ41487

SEQ ID NO: 116957 - RNA, 1410 nt, Artificial Sequence; identical to SEQ ID NO: 108240
  derived and/or modified sequence opt2 from neuraminidase__InfluenzaA__AHZ41498

SEQ ID NO: 116958 - RNA, 1410 nt, Artificial Sequence; identical to SEQ ID NO: 108240
  derived and/or modified sequence opt2 from neuraminidase__InfluenzaA__AHZ41509

SEQ ID NO: 116959 - RNA, 1410 nt, Artificial Sequence; identical to SEQ ID NO: 108240
  derived and/or modified sequence opt2 from neuraminidase__InfluenzaA__AHZ41520

SEQ ID NO: 116960 - RNA, 1410 nt, Artificial Sequence; identical to SEQ ID NO: 108240
  derived and/or modified sequence opt2 from neuraminidase__InfluenzaA__AHZ41531

SEQ ID NO: 116961 - RNA, 1410 nt, Artificial Sequence; identical to SEQ ID NO: 108240
  derived and/or modified sequence opt2 from neuraminidase__InfluenzaA__AHZ41542

SEQ ID NO: 116962 - RNA, 1410 nt, Artificial Sequence; identical to SEQ ID NO: 108240
  derived and/or modified sequence opt2 from neuraminidase__InfluenzaA__AHZ41553

SEQ ID NO: 116963 - RNA, 1410 nt, Artificial Sequence; identical to SEQ ID NO: 108240
  derived and/or modified sequence opt2 from neuraminidase__InfluenzaA__AHZ41564

SEQ ID NO: 116964 - RNA, 1410 nt, Artificial Sequence; identical to SEQ ID NO: 108240
  derived and/or modified sequence opt2 from neuraminidase__InfluenzaA__AHZ41586

SEQ ID NO: 116965 - RNA, 1410 nt, Artificial Sequence; identical to SEQ ID NO: 108240
  derived and/or modified sequence opt2 from neuraminidase__InfluenzaA__AHZ41597

SEQ ID NO: 116966 - RNA, 1410 nt, Artificial Sequence; identical to SEQ ID NO: 108240
  derived and/or modified sequence opt2 from neuraminidase__InfluenzaA__AHZ41608

SEQ ID NO: 116967 - RNA, 1410 nt, Artificial Sequence; identical to SEQ ID NO: 108240
  derived and/or modified sequence opt2 from neuraminidase__InfluenzaA__AHZ41619

SEQ ID NO: 116968 - RNA, 1410 nt, Artificial Sequence; identical to SEQ ID NO: 108240
  derived and/or modified sequence opt2 from neuraminidase__InfluenzaA__AHZ41630

SEQ ID NO: 116969 - RNA, 1410 nt, Artificial Sequence; identical to SEQ ID NO: 108240
  derived and/or modified sequence opt2 from neuraminidase__InfluenzaA__AHZ41641

SEQ ID NO: 116970 - RNA, 1410 nt, Artificial Sequence; identical to SEQ ID NO: 108240
  derived and/or modified sequence opt2 from neuraminidase__InfluenzaA__AHZ41652

SEQ ID NO: 116971 - RNA, 1410 nt, Artificial Sequence; identical to SEQ ID NO: 108240
  derived and/or modified sequence opt2 from neuraminidase__InfluenzaA__AHZ41663

SEQ ID NO: 116972 - RNA, 1410 nt, Artificial Sequence; identical to SEQ ID NO: 108240
  derived and/or modified sequence opt2 from neuraminidase__InfluenzaA__AHZ41674

SEQ ID NO: 116973 - RNA, 1410 nt, Artificial Sequence; identical to SEQ ID NO: 108240
  derived and/or modified sequence opt2 from neuraminidase__InfluenzaA__AHZ41685

SEQ ID NO: 116974 - RNA, 1410 nt, Artificial Sequence; identical to SEQ ID NO: 108240
  derived and/or modified sequence opt2 from neuraminidase__InfluenzaA__AHZ41696

SEQ ID NO: 116975 - RNA, 1410 nt, Artificial Sequence; identical to SEQ ID NO: 108240
  derived and/or modified sequence opt2 from neuraminidase__InfluenzaA__AHZ41707

SEQ ID NO: 116976 - RNA, 1410 nt, Artificial Sequence; identical to SEQ ID NO: 108240
  derived and/or modified sequence opt2 from neuraminidase__InfluenzaA__AHZ41718

SEQ ID NO: 116977 - RNA, 1410 nt, Artificial Sequence; identical to SEQ ID NO: 108240
  derived and/or modified sequence opt2 from neuraminidase__InfluenzaA__AHZ41729

SEQ ID NO: 116978 - RNA, 1410 nt, Artificial Sequence; identical to SEQ ID NO: 108240
  derived and/or modified sequence opt2 from neuraminidase__InfluenzaA__AHZ41740

SEQ ID NO: 116979 - RNA, 1410 nt, Artificial Sequence; identical to SEQ ID NO: 108240
  derived and/or modified sequence opt2 from neuraminidase__InfluenzaA__AHZ41751

SEQ ID NO: 116980 - RNA, 1410 nt, Artificial Sequence; identical to SEQ ID NO: 108240
  derived and/or modified sequence opt2 from neuraminidase__InfluenzaA__AHZ41762

SEQ ID NO: 116981 - RNA, 1410 nt, Artificial Sequence; identical to SEQ ID NO: 114901
  derived and/or modified sequence opt2 from neuraminidase__InfluenzaA__AHZ42564

SEQ ID NO: 116982 - RNA, 1410 nt, Artificial Sequence; identical to SEQ ID NO: 113658
  derived and/or modified sequence opt2 from neuraminidase__InfluenzaA__AHZ42575

SEQ ID NO: 116983 - RNA, 1410 nt, Artificial Sequence
  derived and/or modified sequence opt2 from neuraminidase__InfluenzaA__AHZ42587
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaugugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116984 - RNA, 1413 nt, Artificial Sequence
  derived and/or modified sequence opt2 from neuraminidase__InfluenzaA__AHZ42599
augaaccccaaccagaagaucaucaccaucggcuccgucucccucaccaucuccaccaucugcuucuucaugcagaucgccauccucaucaccaccgucacccuccacuucaagcaguacgaguucaacuccccccccaagaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccgagaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116985 - RNA, 1410 nt, Artificial Sequence; identical to SEQ ID NO: 116304
  derived and/or modified sequence opt2 from neuraminidase__InfluenzaA__AHZ42611

SEQ ID NO: 116986 - RNA, 1410 nt, Artificial Sequence; identical to SEQ ID NO: 113658
  derived and/or modified sequence opt2 from neuraminidase__InfluenzaA__AHZ42622

SEQ ID NO: 116987 - RNA, 1410 nt, Artificial Sequence; identical to SEQ ID NO: 116845
  derived and/or modified sequence opt2 from neuraminidase__InfluenzaA__AHZ42634

SEQ ID NO: 116988 - RNA, 1410 nt, Artificial Sequence; identical to SEQ ID NO: 116888
  derived and/or modified sequence opt2 from neuraminidase__InfluenzaA__AHZ42646

SEQ ID NO: 116989 - RNA, 1410 nt, Artificial Sequence; identical to SEQ ID NO: 113658
  derived and/or modified sequence opt2 from neuraminidase__InfluenzaA__AHZ42657

SEQ ID NO: 116990 - RNA, 1410 nt, Artificial Sequence; identical to SEQ ID NO: 116605
  derived and/or modified sequence opt2 from neuraminidase__InfluenzaA__AHZ42669

SEQ ID NO: 116991 - RNA, 1410 nt, Artificial Sequence; identical to SEQ ID NO: 113658
  derived and/or modified sequence opt2 from neuraminidase__InfluenzaA__AHZ42681

SEQ ID NO: 116992 - RNA, 1410 nt, Artificial Sequence
  derived and/or modified sequence opt2 from neuraminidase__InfluenzaA__AHZ42693
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 116993 - RNA, 1410 nt, Artificial Sequence; identical to SEQ ID NO: 113658
  derived and/or modified sequence opt2 from neuraminidase__InfluenzaA__AHZ42704

SEQ ID NO: 116994 - RNA, 1410 nt, Artificial Sequence
  derived and/or modified sequence opt2 from neuraminidase__InfluenzaA__AHZ42716
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaaguuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116995 - RNA, 1410 nt, Artificial Sequence; identical to SEQ ID NO: 113658
  derived and/or modified sequence opt2 from neuraminidase__InfluenzaA__AHZ42728

SEQ ID NO: 116996 - RNA, 1410 nt, Artificial Sequence; identical to SEQ ID NO: 114901
  derived and/or modified sequence opt2 from neuraminidase__InfluenzaA__AHZ42740

SEQ ID NO: 116997 - RNA, 1410 nt, Artificial Sequence; identical to SEQ ID NO: 114869
  derived and/or modified sequence opt2 from neuraminidase__InfluenzaA__AHZ42751

SEQ ID NO: 116998 - RNA, 1410 nt, Artificial Sequence
  derived and/or modified sequence opt2 from neuraminidase__InfluenzaA__AHZ42763
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucgucuacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 116999 - RNA, 1410 nt, Artificial Sequence; identical to SEQ ID NO: 114887
  derived and/or modified sequence opt2 from neuraminidase__InfluenzaA__AHZ42775

SEQ ID NO: 117000 - RNA, 1410 nt, Artificial Sequence; identical to SEQ ID NO: 113658
  derived and/or modified sequence opt2 from neuraminidase__InfluenzaA__AHZ42787

SEQ ID NO: 117001 - RNA, 1410 nt, Artificial Sequence
  derived and/or modified sequence opt2 from neuraminidase__InfluenzaA__AHZ42799
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucaucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117002 - RNA, 1410 nt, Artificial Sequence
  derived and/or modified sequence opt2 from neuraminidase__InfluenzaA__AHZ42811
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucggccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117003 - RNA, 1410 nt, Artificial Sequence
  derived and/or modified sequence opt2 from neuraminidase__InfluenzaA__AHZ42823
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccgagcaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117004 - RNA, 1410 nt, Artificial Sequence
  derived and/or modified sequence opt2 from neuraminidase__InfluenzaA__AHZ42834
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117005 - RNA, 1410 nt, Artificial Sequence; identical to SEQ ID NO: 113658
  derived and/or modified sequence opt2 from neuraminidase__InfluenzaA__AHZ42846

SEQ ID NO: 117006 - RNA, 1410 nt, Artificial Sequence; identical to SEQ ID NO: 113658
  derived and/or modified sequence opt2 from neuraminidase__InfluenzaA__AHZ42858

SEQ ID NO: 117007 - RNA, 1410 nt, Artificial Sequence; identical to SEQ ID NO: 113658
  derived and/or modified sequence opt2 from neuraminidase__InfluenzaA__AHZ42870

SEQ ID NO: 117008 - RNA, 1410 nt, Artificial Sequence; identical to SEQ ID NO: 113658
  derived and/or modified sequence opt2 from neuraminidase__InfluenzaA__AHZ42882

SEQ ID NO: 117009 - RNA, 1410 nt, Artificial Sequence
  derived and/or modified sequence opt2 from neuraminidase__InfluenzaA__AHZ42894
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117010 - RNA, 1410 nt, Artificial Sequence; identical to SEQ ID NO: 113658
  derived and/or modified sequence opt2 from neuraminidase__InfluenzaA__AHZ42906

SEQ ID NO: 117011 - RNA, 1410 nt, Artificial Sequence; identical to SEQ ID NO: 114887
  derived and/or modified sequence opt2 from neuraminidase__InfluenzaA__AHZ42918

SEQ ID NO: 117012 - RNA, 1398 nt, Artificial Sequence; identical to SEQ ID NO: 114966
  derived and/or modified sequence opt2 from neuraminidase__InfluenzaA__AHZ59750

SEQ ID NO: 117013 - RNA, 1398 nt, Artificial Sequence; identical to SEQ ID NO: 114966
  derived and/or modified sequence opt2 from neuraminidase__InfluenzaA__AHZ59762

SEQ ID NO: 117014 - RNA, 1398 nt, Artificial Sequence; identical to SEQ ID NO: 114966
  derived and/or modified sequence opt2 from neuraminidase__InfluenzaA__AHZ59774

SEQ ID NO: 117015 - RNA, 1398 nt, Artificial Sequence; identical to SEQ ID NO: 114966
  derived and/or modified sequence opt2 from neuraminidase__InfluenzaA__AHZ59786

SEQ ID NO: 117016 - RNA, 1398 nt, Artificial Sequence; identical to SEQ ID NO: 114966
  derived and/or modified sequence opt2 from neuraminidase__InfluenzaA__AHZ59798

SEQ ID NO: 117017 - RNA, 1398 nt, Artificial Sequence; identical to SEQ ID NO: 114966
  derived and/or modified sequence opt2 from neuraminidase__InfluenzaA__AHZ59810

SEQ ID NO: 117018 - RNA, 1398 nt, Artificial Sequence; identical to SEQ ID NO: 114966
  derived and/or modified sequence opt2 from neuraminidase__InfluenzaA__AHZ59822

SEQ ID NO: 117019 - RNA, 1398 nt, Artificial Sequence; identical to SEQ ID NO: 114966
  derived and/or modified sequence opt2 from neuraminidase__InfluenzaA__AHZ59834

SEQ ID NO: 117020 - RNA, 1398 nt, Artificial Sequence; identical to SEQ ID NO: 114966
  derived and/or modified sequence opt2 from neuraminidase__InfluenzaA__AHZ59846

SEQ ID NO: 117021 - RNA, 1398 nt, Artificial Sequence; identical to SEQ ID NO: 114966
  derived and/or modified sequence opt2 from neuraminidase__InfluenzaA__AHZ59858

SEQ ID NO: 117022 - RNA, 1398 nt, Artificial Sequence; identical to SEQ ID NO: 114966
  derived and/or modified sequence opt2 from neuraminidase__InfluenzaA__AHZ59870

SEQ ID NO: 117023 - RNA, 1398 nt, Artificial Sequence; identical to SEQ ID NO: 114966
  derived and/or modified sequence opt2 from neuraminidase__InfluenzaA__AHZ59882

SEQ ID NO: 117024 - RNA, 1398 nt, Artificial Sequence; identical to SEQ ID NO: 114966
  derived and/or modified sequence opt2 from neuraminidase__InfluenzaA__AHZ59918

SEQ ID NO: 117025 - RNA, 1398 nt, Artificial Sequence; identical to SEQ ID NO: 114966
  derived and/or modified sequence opt2 from neuraminidase__InfluenzaA__AHZ59930

SEQ ID NO: 117026 - RNA, 1398 nt, Artificial Sequence; identical to SEQ ID NO: 114966
  derived and/or modified sequence opt2 from neuraminidase__InfluenzaA__AHZ59942

SEQ ID NO: 117027 - RNA, 1398 nt, Artificial Sequence; identical to SEQ ID NO: 114966
  derived and/or modified sequence opt2 from neuraminidase__InfluenzaA__AHZ59954

SEQ ID NO: 117028 - RNA, 1398 nt, Artificial Sequence; identical to SEQ ID NO: 114966
  derived and/or modified sequence opt2 from neuraminidase__InfluenzaA__AHZ59966

SEQ ID NO: 117029 - RNA, 1398 nt, Artificial Sequence; identical to SEQ ID NO: 114966
  derived and/or modified sequence opt2 from neuraminidase__InfluenzaA__AHZ59991

SEQ ID NO: 117030 - RNA, 1398 nt, Artificial Sequence; identical to SEQ ID NO: 114966
  derived and/or modified sequence opt2 from neuraminidase__InfluenzaA__AHZ60003

SEQ ID NO: 117031 - RNA, 1398 nt, Artificial Sequence; identical to SEQ ID NO: 114966
  derived and/or modified sequence opt2 from neuraminidase__InfluenzaA__AHZ60015

SEQ ID NO: 117032 - RNA, 1398 nt, Artificial Sequence; identical to SEQ ID NO: 114966
  derived and/or modified sequence opt2 from neuraminidase__InfluenzaA__AHZ60027

SEQ ID NO: 117033 - RNA, 1398 nt, Artificial Sequence; identical to SEQ ID NO: 114966
  derived and/or modified sequence opt2 from neuraminidase__InfluenzaA__AHZ60039

SEQ ID NO: 117034 - RNA, 1398 nt, Artificial Sequence; identical to SEQ ID NO: 114966
  derived and/or modified sequence opt2 from neuraminidase__InfluenzaA__AHZ60051

SEQ ID NO: 117035 - RNA, 1398 nt, Artificial Sequence; identical to SEQ ID NO: 114966
  derived and/or modified sequence opt2 from neuraminidase__InfluenzaA__AHZ60063

SEQ ID NO: 117036 - RNA, 1398 nt, Artificial Sequence; identical to SEQ ID NO: 114966
  derived and/or modified sequence opt2 from neuraminidase__InfluenzaA__AHZ60075

SEQ ID NO: 117037 - RNA, 1398 nt, Artificial Sequence; identical to SEQ ID NO: 114966
  derived and/or modified sequence opt2 from neuraminidase__InfluenzaA__AHZ60087

SEQ ID NO: 117038 - RNA, 1398 nt, Artificial Sequence; identical to SEQ ID NO: 114966
  derived and/or modified sequence opt2 from neuraminidase__InfluenzaA__AHZ60099

SEQ ID NO: 117039 - RNA, 1410 nt, Artificial Sequence; identical to SEQ ID NO: 113658
  derived and/or modified sequence opt2 from neuraminidase__InfluenzaA__AHZ60111

SEQ ID NO: 117040 - RNA, 1410 nt, Artificial Sequence; identical to SEQ ID NO: 107914
  derived and/or modified sequence opt2 from neuraminidase__InfluenzaA__AIA26299

SEQ ID NO: 117041 - RNA, 1374 nt, Artificial Sequence
  derived and/or modified sequence opt2 from neuraminidase__InfluenzaA__AIC64891
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117042 - RNA, 1350 nt, Artificial Sequence
  derived and/or modified sequence opt2 from neuraminidase__InfluenzaA__AID48084
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaaccuccucaccgagaagaccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcgccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 117043 - RNA, 1410 nt, Artificial Sequence
  derived and/or modified sequence opt2 from neuraminidase__InfluenzaA__AID70507
augaaccccaaccagaagaucaucaccaucggcuccgucugcaccaccaucggcauggccaaccucauccuccagaucggcaacaucaucuccaucuggaucucccacuccauccagcucggcaaccagaaccagaucgagaccugcaaccaguccgucaucaccuacgagaacaagaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcgaccccgucuccuucaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguucuggcccgacggcgccgagcuccccuucaccaucgacaaguga

SEQ ID NO: 117044 - RNA, 1410 nt, Artificial Sequence
  derived and/or modified sequence opt2 from neuraminidase__InfluenzaA__AID70508
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccaacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117045 - RNA, 1410 nt, Artificial Sequence
  derived and/or modified sequence opt2 from neuraminidase__InfluenzaA__AID70509
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117046 - RNA, 1410 nt, Artificial Sequence
  derived and/or modified sequence opt2 from neuraminidase__InfluenzaA__AID70510
augaaccccaaccagaagaucaucaccaucggcuccgucugcaucaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117047 - RNA, 1410 nt, Artificial Sequence
  derived and/or modified sequence opt2 from neuraminidase__InfluenzaA__AID70511
augaaccccaaccagaagaucaucaccaugggcuccgucuggaugaccaucggcauggccaaccucauccuccaguccggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117048 - RNA, 1410 nt, Artificial Sequence
  derived and/or modified sequence opt2 from neuraminidase__InfluenzaA__AID70512
augaaccccaaccagaagaucaucaccaucggcuccgucuggaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117049 - RNA, 1410 nt, Artificial Sequence; identical to SEQ ID NO: 111769
  derived and/or modified sequence opt2 from neuraminidase__InfluenzaA__AID70514

SEQ ID NO: 117050 - RNA, 1410 nt, Artificial Sequence
  derived and/or modified sequence opt2 from neuraminidase__InfluenzaA__AID70515
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacuccaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117051 - RNA, 1410 nt, Artificial Sequence; identical to SEQ ID NO: 114670
  derived and/or modified sequence opt2 from neuraminidase__InfluenzaA__AID70516

SEQ ID NO: 117052 - RNA, 1410 nt, Artificial Sequence
  derived and/or modified sequence opt2 from neuraminidase__InfluenzaA__AID70517
augaaccccaaccagaagaucaucaccaucggcuccgucugcaugaccaucggcauggccaaccucacccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117053 - RNA, 1410 nt, Artificial Sequence
  derived and/or modified sequence opt2 from neuraminidase__InfluenzaA__AID70518
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagauccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117054 - RNA, 1410 nt, Artificial Sequence
  derived and/or modified sequence opt2 from neuraminidase__InfluenzaA__AID70519
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117055 - RNA, 1410 nt, Artificial Sequence
  derived and/or modified sequence opt2 from neuraminidase__InfluenzaA__AID70520
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 117056 - RNA, 1410 nt, Artificial Sequence
  derived and/or modified sequence opt2 from neuraminidase__InfluenzaA__AID70521
augaaccccaaccagaagaucaucaccaucggcuccgucucccucaccaucucccgcaucugcuucuucaugcagaucgccauccucaucaacaccgucacccuccacuucaagcaguacgaguucaacuccccccccaacaaccaggucaugcucugcgagcccaccaucaucgagcgcaacaucaccaagaucgucuaccucaccaacaccaccaucgagaaggagaucugccccaagcucgccgaguaccgcuccugguccaagccccagugcgacaucaccggcuucgcccccuucuccaaggacaacuccauccgccucuccgccggcggcgacaucugggucacccgcgagcccuacgucuccugcgaccccgacaagugcuuccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccaucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggcuucgucggcgacaccccccgcaagcccgaccgcuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucggcggcugguccaaccccaacuccaagucccagaucaaccgccaggucaucgucgaccgcggcaaccgcuccggcuacuccggcaucuucuccgucgagggcaaguccugcaucaaccgcugcuucuacgucgagcucauccgcggccgcaaggacgagaccgagguccucuggaccuccaacuccaucgucgucuucugcggcaccuccggcaccuacggcaccggcuccuggcccgacggcgccgacaucaaccucaugcccaucuga

SEQ ID NO: 117057 - RNA, 1410 nt, Artificial Sequence
  derived and/or modified sequence opt2 from neuraminidase__InfluenzaA__AID70522
augaaccccaaccagaagaucaucaccaucggcuccgucucccucaccaucuccaccaucugcuucuucaugcagaucgccauccucaucaccaccgucacccuccacuuccgccaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117058 - RNA, 1410 nt, Artificial Sequence
  derived and/or modified sequence opt2 from neuraminidase__InfluenzaA__AID70523
augaaccccaaccagaagaucaagaccaucggcuccgucucccucaccaacuccaccaucugcaucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaguucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117059 - RNA, 1410 nt, Artificial Sequence
  derived and/or modified sequence opt2 from neuraminidase__InfluenzaA__AID70524
augaaccccaaccagaagaucaucaccaucggcgccgucuggcgcaccaucuccaccaucugcuucuucaugcagaucgccuuccucaucaccaccgucacccuccacuucaagcaguacgaguucaacuccccccccaacaaccaggucaugcccugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117060 - RNA, 1410 nt, Artificial Sequence
  derived and/or modified sequence opt2 from neuraminidase__InfluenzaA__AID70525
augaaccccaaccagaagaucaucaccaucggcuccgucucccucaccaucuggaucaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaacaucaugcccaucuga

SEQ ID NO: 117061 - RNA, 1410 nt, Artificial Sequence; identical to SEQ ID NO: 111030
  derived and/or modified sequence opt2 from neuraminidase__InfluenzaA__AID70526

SEQ ID NO: 117062 - RNA, 1410 nt, Artificial Sequence
  derived and/or modified sequence opt2 from neuraminidase__InfluenzaA__AID70527
augaaccccaaccagaagaucaucaccaucggcuccgucucccucaccauguggaucaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117063 - RNA, 1410 nt, Artificial Sequence
  derived and/or modified sequence opt2 from neuraminidase__InfluenzaA__AID70528
augaaccccaaccagaagaucaucaccaucggcuccgucucccucuccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117064 - RNA, 1410 nt, Artificial Sequence; identical to SEQ ID NO: 111030
  derived and/or modified sequence opt2 from neuraminidase__InfluenzaA__AID70529

SEQ ID NO: 117065 - RNA, 1410 nt, Artificial Sequence
  derived and/or modified sequence opt2 from neuraminidase__InfluenzaA__AID70530
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaacaucaugcccaucuga

SEQ ID NO: 117066 - RNA, 1410 nt, Artificial Sequence; identical to SEQ ID NO: 111030
  derived and/or modified sequence opt2 from neuraminidase__InfluenzaA__AID70531

SEQ ID NO: 117067 - RNA, 1410 nt, Artificial Sequence
  derived and/or modified sequence opt2 from neuraminidase__InfluenzaA__AID70532
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagacccucaaggucaucgagggcugguccaaccccaaguccaagcuccagaucaaccgccaggucaucgucgaccgcggcaaccgcuccggcuacuacggcaucuucuccgucgagggcaaguccugcaucaaccgcugcuucuacgucgagcucaucuggggccgcaaggaggagaucgagguccucuggaccuccaacuccaaggucgucuucugcggcaccuccggcaccuacggcaccggcuccucccccgacggcgccgaccucaacuucaugcccaucuga

SEQ ID NO: 117068 - RNA, 1410 nt, Artificial Sequence
  derived and/or modified sequence opt2 from neuraminidase__InfluenzaA__AID70533
augaaccccaaccagaagaucaucaccaucggcuccgucucccucgccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117069 - RNA, 1410 nt, Artificial Sequence
  derived and/or modified sequence opt2 from neuraminidase__InfluenzaA__AID70534
augaaccccaaccagaagaucaucaccaucggcuccgucucccucuccaucuacaucaucugcuucuucaugcagaucgccauccucaucaccaccgucacccuccacuucaagcaguacgaguucaacuccccccccaacaaccaggccaugcccugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117070 - RNA, 1410 nt, Artificial Sequence
  derived and/or modified sequence opt2 from neuraminidase__InfluenzaA__AID70535
augaaccccaaccagaagaucaucaccaucggcuccgucucccucgccaugugcaccaucugcuucuucaugcagaucgccauccucaucaccaccgucacccuccacuucaagcaguacgaguucaacuccccccccaacaaccaggccaugcccugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117071 - RNA, 1410 nt, Artificial Sequence
  derived and/or modified sequence opt2 from neuraminidase__InfluenzaA__AID70536
augaaccccaaccagaagaucaucaccaucggcuccgucucccucaccaucuccaccgucugcuucuucaugcagaucgccauccucaucaccaccgucacccuccacuucaagcaguacgaguucaacuccccccccaacaaccaggucaugcucugcgagcccaccaucaucgaccgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117072 - RNA, 1410 nt, Artificial Sequence; identical to SEQ ID NO: 111030
  derived and/or modified sequence opt2 from neuraminidase__InfluenzaA__AID70537

SEQ ID NO: 117073 - RNA, 1410 nt, Artificial Sequence
  derived and/or modified sequence opt2 from neuraminidase__InfluenzaA__AID70538
augaaccccaaccagaagaagaucaccaucggcgccgucucccucaccaugugcaccgucugcaucuucaugcagaucgccauccucaucaccaccgucacccuccacuuccgccaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117074 - RNA, 1410 nt, Artificial Sequence
  derived and/or modified sequence opt2 from neuraminidase__InfluenzaA__AID70539
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117075 - RNA, 1410 nt, Artificial Sequence; identical to SEQ ID NO: 111030
  derived and/or modified sequence opt2 from neuraminidase__InfluenzaA__AID70540

SEQ ID NO: 117076 - RNA, 1410 nt, Artificial Sequence; identical to SEQ ID NO: 111030
  derived and/or modified sequence opt2 from neuraminidase__InfluenzaA__AID70541

SEQ ID NO: 117077 - RNA, 1410 nt, Artificial Sequence
  derived and/or modified sequence opt2 from neuraminidase__InfluenzaA__AID70633
augaaccccaaccagaagaucaucaccaucggcuccgucugcaugaccaucggcauggccaaccucauccuccagaucggcaacaucaucuccaucugggucucccacuccauccagcucggcaaccagucccagaucgaggccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117078 - RNA, 1398 nt, Artificial Sequence
  derived and/or modified sequence opt2 from neuraminidase__InfluenzaA__AID70635
augaaccccaagcagaagauccucugcaccuccgccaccgccaucaucaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgacggcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 117079 - RNA, 1401 nt, Artificial Sequence
  derived and/or modified sequence opt2 from neuraminidase__InfluenzaA__AIG44695
augaaccccaaccagaagaucaccgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccuccggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacgucugcgucaccggcgacgacaagaacgccaccgccuccaucaucuacgacggcaugcucgucgacuccgucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacggcugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 117080 - RNA, 1410 nt, Artificial Sequence
  derived and/or modified sequence opt2 from neuraminidase__InfluenzaA__AIJ10793
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggccaucgagggcugguccaaccccaaguccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117081 - RNA, 1410 nt, Artificial Sequence; identical to SEQ ID NO: 111030
  derived and/or modified sequence opt2 from neuraminidase__InfluenzaA__AIJ10794

SEQ ID NO: 117082 - RNA, 1410 nt, Artificial Sequence; identical to SEQ ID NO: 112655
  derived and/or modified sequence opt2 from neuraminidase__InfluenzaA__AIJ10795

SEQ ID NO: 117083 - RNA, 1410 nt, Artificial Sequence; identical to SEQ ID NO: 112655
  derived and/or modified sequence opt2 from neuraminidase__InfluenzaA__AIJ10796

SEQ ID NO: 117084 - RNA, 1410 nt, Artificial Sequence
  derived and/or modified sequence opt2 from neuraminidase__InfluenzaA__AIJ10797
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgaggacaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117085 - RNA, 1410 nt, Artificial Sequence
  derived and/or modified sequence opt2 from neuraminidase__InfluenzaA__AIJ10798
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccacccucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117086 - RNA, 1410 nt, Artificial Sequence; identical to SEQ ID NO: 112655
  derived and/or modified sequence opt2 from neuraminidase__InfluenzaA__AIJ10799

SEQ ID NO: 117087 - RNA, 1410 nt, Artificial Sequence
  derived and/or modified sequence opt2 from neuraminidase__InfluenzaA__AIJ10800
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117088 - RNA, 1410 nt, Artificial Sequence; identical to SEQ ID NO: 113658
  derived and/or modified sequence opt2 from neuraminidase__InfluenzaA__AIJ10801

SEQ ID NO: 117089 - RNA, 1410 nt, Artificial Sequence; identical to SEQ ID NO: 113658
  derived and/or modified sequence opt2 from neuraminidase__InfluenzaA__AIJ10803

SEQ ID NO: 117090 - RNA, 1410 nt, Artificial Sequence; identical to SEQ ID NO: 113658
  derived and/or modified sequence opt2 from neuraminidase__InfluenzaA__AIJ10804

SEQ ID NO: 117091 - RNA, 1410 nt, Artificial Sequence; identical to SEQ ID NO: 113658
  derived and/or modified sequence opt2 from neuraminidase__InfluenzaA__AIJ10805

SEQ ID NO: 117092 - RNA, 1410 nt, Artificial Sequence
  derived and/or modified sequence opt2 from neuraminidase__InfluenzaA__AIJ10806
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccaucucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117093 - RNA, 1410 nt, Artificial Sequence
  derived and/or modified sequence opt2 from neuraminidase__InfluenzaA__AIJ10807
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgaggccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117094 - RNA, 1410 nt, Artificial Sequence
  derived and/or modified sequence opt2 from neuraminidase__InfluenzaA__AIJ10808
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagguccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117095 - RNA, 1410 nt, Artificial Sequence; identical to SEQ ID NO: 113658
  derived and/or modified sequence opt2 from neuraminidase__InfluenzaA__AIJ10809

SEQ ID NO: 117096 - RNA, 1410 nt, Artificial Sequence; identical to SEQ ID NO: 113658
  derived and/or modified sequence opt2 from neuraminidase__InfluenzaA__AIJ10810

SEQ ID NO: 117097 - RNA, 1410 nt, Artificial Sequence
  derived and/or modified sequence opt2 from neuraminidase__InfluenzaA__AIJ10812
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucauggagcgcaacgucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117098 - RNA, 1410 nt, Artificial Sequence
  derived and/or modified sequence opt2 from neuraminidase__InfluenzaA__AIJ10813
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucauggagcgcaacgucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaaccccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117099 - RNA, 1410 nt, Artificial Sequence
  derived and/or modified sequence opt2 from neuraminidase__InfluenzaA__AIJ10814
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucgucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117100 - RNA, 1410 nt, Artificial Sequence
  derived and/or modified sequence opt2 from neuraminidase__InfluenzaA__AIJ10815
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 117101 - RNA, 1410 nt, Artificial Sequence
  derived and/or modified sequence opt2 from neuraminidase__InfluenzaA__AIJ10816
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaagggcugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117102 - RNA, 1410 nt, Artificial Sequence; identical to SEQ ID NO: 113658
  derived and/or modified sequence opt2 from neuraminidase__InfluenzaA__AIJ10817

SEQ ID NO: 117103 - RNA, 1410 nt, Artificial Sequence; identical to SEQ ID NO: 113658
  derived and/or modified sequence opt2 from neuraminidase__InfluenzaA__AIJ10818

SEQ ID NO: 117104 - RNA, 1410 nt, Artificial Sequence
  derived and/or modified sequence opt2 from neuraminidase__InfluenzaA__AIJ10819
augaaccccaaccagaagaucaucaccaucggcuccgucucccucaccaucuccaccaucugcuucuucaugcagaucgccauccucaucaccaccgucgcccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccaacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117105 - RNA, 1410 nt, Artificial Sequence; identical to SEQ ID NO: 113658
  derived and/or modified sequence opt2 from neuraminidase__InfluenzaA__AIJ10820

SEQ ID NO: 117106 - RNA, 1410 nt, Artificial Sequence; identical to SEQ ID NO: 113658
  derived and/or modified sequence opt2 from neuraminidase__InfluenzaA__AIJ10821

SEQ ID NO: 117107 - RNA, 1410 nt, Artificial Sequence
  derived and/or modified sequence opt2 from neuraminidase__InfluenzaA__AIJ10822
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 117108 - RNA, 1410 nt, Artificial Sequence
  derived and/or modified sequence opt2 from neuraminidase__InfluenzaA__AIJ10823
augaaccccaaccagaagaucaucaccaucggcuccgucucccucaccaucuccaccaucugcuucuucaugcagaucgccauccucaucaccaccgucacccuccacuucaaccaguacgaguucaacuccccccccaacaaccaggucaugcucugcgagcccaccaucaucgagcgcaacaucaccgagaucgucuaccucaccaccaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuuccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgucaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccggcuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117109 - RNA, 1410 nt, Artificial Sequence
  derived and/or modified sequence opt2 from neuraminidase__InfluenzaA__AIJ10824
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117110 - RNA, 1410 nt, Artificial Sequence
  derived and/or modified sequence opt2 from neuraminidase__InfluenzaA__AIJ10827
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117111 - RNA, 1410 nt, Artificial Sequence
  derived and/or modified sequence opt2 from neuraminidase__InfluenzaA__AIJ10828
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgaggucgucuggaccuccaacuccaucgucgucuucugcggcaccuccggcaccuacggcaccggcuccuggcccgacggcgccgaccucaaccucaugcccaucuga

SEQ ID NO: 117112 - RNA, 1410 nt, Artificial Sequence
  derived and/or modified sequence opt2 from neuraminidase__InfluenzaA__AIJ10829
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaacugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117113 - RNA, 1410 nt, Artificial Sequence
  derived and/or modified sequence opt2 from neuraminidase__InfluenzaA__AIJ10830
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguacaagaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117114 - RNA, 1410 nt, Artificial Sequence; identical to SEQ ID NO: 117110
  derived and/or modified sequence opt2 from neuraminidase__InfluenzaA__AIJ10831

SEQ ID NO: 117115 - RNA, 1410 nt, Artificial Sequence; identical to SEQ ID NO: 117110
  derived and/or modified sequence opt2 from neuraminidase__InfluenzaA__AIJ10832

SEQ ID NO: 117116 - RNA, 1410 nt, Artificial Sequence
  derived and/or modified sequence opt2 from neuraminidase__InfluenzaA__AIJ10834
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgaguccaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117117 - RNA, 1410 nt, Artificial Sequence
  derived and/or modified sequence opt2 from neuraminidase__InfluenzaA__AIJ10835
augaaccccaaccagaagaucaucaccaucggcuccgucucccucaccaucuccaccaucugcuucuucaugcagaucgccauccucaucaccaccgucacccuccacuucaagcaguacgaguucaacuccacccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117118 - RNA, 1410 nt, Artificial Sequence; identical to SEQ ID NO: 117110
  derived and/or modified sequence opt2 from neuraminidase__InfluenzaA__AIJ10836

SEQ ID NO: 117119 - RNA, 1410 nt, Artificial Sequence
  derived and/or modified sequence opt2 from neuraminidase__InfluenzaA__AIJ10837
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117120 - RNA, 1410 nt, Artificial Sequence; identical to SEQ ID NO: 117110
  derived and/or modified sequence opt2 from neuraminidase__InfluenzaA__AIJ10838

SEQ ID NO: 117121 - RNA, 1410 nt, Artificial Sequence
  derived and/or modified sequence opt2 from neuraminidase__InfluenzaA__AIJ10841
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117122 - RNA, 1410 nt, Artificial Sequence
  derived and/or modified sequence opt2 from neuraminidase__InfluenzaA__AIJ10842
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117123 - RNA, 1410 nt, Artificial Sequence; identical to SEQ ID NO: 117110
  derived and/or modified sequence opt2 from neuraminidase__InfluenzaA__AIJ10843

SEQ ID NO: 117124 - RNA, 1410 nt, Artificial Sequence
  derived and/or modified sequence opt2 from neuraminidase__InfluenzaA__AIJ10844
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuuccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgucaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccggcuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucaagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117125 - RNA, 1410 nt, Artificial Sequence
  derived and/or modified sequence opt2 from neuraminidase__InfluenzaA__AIJ10845
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaucaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuuccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgucaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccggcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117126 - RNA, 1410 nt, Artificial Sequence
  derived and/or modified sequence opt2 from neuraminidase__InfluenzaA__AIJ10847
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117127 - RNA, 1410 nt, Artificial Sequence; identical to SEQ ID NO: 117110
  derived and/or modified sequence opt2 from neuraminidase__InfluenzaA__AIJ10848

SEQ ID NO: 117128 - RNA, 1410 nt, Artificial Sequence
  derived and/or modified sequence opt2 from neuraminidase__InfluenzaA__AIJ10849
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuuccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgucaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccggcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117129 - RNA, 1410 nt, Artificial Sequence; identical to SEQ ID NO: 117128
  derived and/or modified sequence opt2 from neuraminidase__InfluenzaA__AIJ10851

SEQ ID NO: 117130 - RNA, 1410 nt, Artificial Sequence; identical to SEQ ID NO: 117128
  derived and/or modified sequence opt2 from neuraminidase__InfluenzaA__AIJ10852

SEQ ID NO: 117131 - RNA, 1410 nt, Artificial Sequence; identical to SEQ ID NO: 117124
  derived and/or modified sequence opt2 from neuraminidase__InfluenzaA__AIJ10853

SEQ ID NO: 117132 - RNA, 1410 nt, Artificial Sequence; identical to SEQ ID NO: 117124
  derived and/or modified sequence opt2 from neuraminidase__InfluenzaA__AIJ10854

SEQ ID NO: 117133 - RNA, 1410 nt, Artificial Sequence
  derived and/or modified sequence opt2 from neuraminidase__InfluenzaA__AIJ10855
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuuccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgucaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccggcuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117134 - RNA, 1410 nt, Artificial Sequence
  derived and/or modified sequence opt2 from neuraminidase__InfluenzaA__AIJ10856
augaaccccaacaagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaagaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuucuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccaucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117135 - RNA, 1410 nt, Artificial Sequence; identical to SEQ ID NO: 117110
  derived and/or modified sequence opt2 from neuraminidase__InfluenzaA__AIJ10857

SEQ ID NO: 117136 - RNA, 1410 nt, Artificial Sequence; identical to SEQ ID NO: 113658
  derived and/or modified sequence opt2 from neuraminidase__InfluenzaA__AIJ29348

SEQ ID NO: 117137 - RNA, 1410 nt, Artificial Sequence; identical to SEQ ID NO: 113658
  derived and/or modified sequence opt2 from neuraminidase__InfluenzaA__AIJ29350

SEQ ID NO: 117138 - RNA, 1410 nt, Artificial Sequence
  derived and/or modified sequence opt2 from neuraminidase__InfluenzaA__AIJ29352
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccaaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117139 - RNA, 1410 nt, Artificial Sequence; identical to SEQ ID NO: 112655
  derived and/or modified sequence opt2 from neuraminidase__InfluenzaA__AIJ29354

SEQ ID NO: 117140 - RNA, 1410 nt, Artificial Sequence; identical to SEQ ID NO: 114434
  derived and/or modified sequence opt2 from neuraminidase__InfluenzaA__AIJ29356

SEQ ID NO: 117141 - RNA, 1410 nt, Artificial Sequence; identical to SEQ ID NO: 114434
  derived and/or modified sequence opt2 from neuraminidase__InfluenzaA__AIJ29358

SEQ ID NO: 117142 - RNA, 1410 nt, Artificial Sequence
  derived and/or modified sequence opt2 from neuraminidase__InfluenzaA__AIJ29360
augaaccccaaccagaagaucaucaccaucggcuccgucucccucaccaucuccaccaucugcuucuucaugcagaucgccauccucaccaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117143 - RNA, 1410 nt, Artificial Sequence; identical to SEQ ID NO: 113658
  derived and/or modified sequence opt2 from neuraminidase__InfluenzaA__AIJ29362

SEQ ID NO: 117144 - RNA, 1410 nt, Artificial Sequence
  derived and/or modified sequence opt2 from neuraminidase__InfluenzaA__AIL93626
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccuacgucaaccagaccuacgucaacaucuccaacaccaacuucgccgccggccgcuccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccguccucuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117145 - RNA, 1410 nt, Artificial Sequence
  derived and/or modified sequence opt2 from neuraminidase__InfluenzaA__AIL93648
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggccgcaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117146 - RNA, 1410 nt, Artificial Sequence; identical to SEQ ID NO: 113658
  derived and/or modified sequence opt2 from neuraminidase__InfluenzaA__AIL93660

SEQ ID NO: 117147 - RNA, 1410 nt, Artificial Sequence; identical to SEQ ID NO: 113658
  derived and/or modified sequence opt2 from neuraminidase__InfluenzaA__AIL93672

SEQ ID NO: 117148 - RNA, 1410 nt, Artificial Sequence
  derived and/or modified sequence opt2 from neuraminidase__InfluenzaA__AIL93684
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuccgccaccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccguccucuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucuggaucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117149 - RNA, 1410 nt, Artificial Sequence
  derived and/or modified sequence opt2 from neuraminidase__InfluenzaA__AIL93719
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117150 - RNA, 1410 nt, Artificial Sequence; identical to SEQ ID NO: 117149
  derived and/or modified sequence opt2 from neuraminidase__InfluenzaA__AIL93743

SEQ ID NO: 117151 - RNA, 1410 nt, Artificial Sequence; identical to SEQ ID NO: 117149
  derived and/or modified sequence opt2 from neuraminidase__InfluenzaA__AIL93755

SEQ ID NO: 117152 - RNA, 1410 nt, Artificial Sequence; identical to SEQ ID NO: 113658
  derived and/or modified sequence opt2 from neuraminidase__InfluenzaA__AIL93767

SEQ ID NO: 117153 - RNA, 1410 nt, Artificial Sequence; identical to SEQ ID NO: 113658
  derived and/or modified sequence opt2 from neuraminidase__InfluenzaA__AIL93779

SEQ ID NO: 117154 - RNA, 1410 nt, Artificial Sequence
  derived and/or modified sequence opt2 from neuraminidase__InfluenzaA__AIL93791
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacacccgcacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117155 - RNA, 1410 nt, Artificial Sequence; identical to SEQ ID NO: 117149
  derived and/or modified sequence opt2 from neuraminidase__InfluenzaA__AIL93803

SEQ ID NO: 117156 - RNA, 1410 nt, Artificial Sequence
  derived and/or modified sequence opt2 from neuraminidase__InfluenzaA__AIL93815
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuacuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117157 - RNA, 1410 nt, Artificial Sequence; identical to SEQ ID NO: 113658
  derived and/or modified sequence opt2 from neuraminidase__InfluenzaA__AIL93827

SEQ ID NO: 117158 - RNA, 1410 nt, Artificial Sequence
  derived and/or modified sequence opt2 from neuraminidase__InfluenzaA__AIL93839
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccaccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117159 - RNA, 1410 nt, Artificial Sequence
  derived and/or modified sequence opt2 from neuraminidase__InfluenzaA__AIL93850
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccaccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaagggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117160 - RNA, 1410 nt, Artificial Sequence; identical to SEQ ID NO: 117149
  derived and/or modified sequence opt2 from neuraminidase__InfluenzaA__AIL93861

SEQ ID NO: 117161 - RNA, 1410 nt, Artificial Sequence
  derived and/or modified sequence opt2 from neuraminidase__InfluenzaA__AIL93885
augaaccccaaccagaagaucaucaccaucggcuccgucucccucaccaucuccaccaucugcuucuucaugcagaucgccauccucaucaccaccgucacccuccacuucaagcaguacgaguucgacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcgucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117162 - RNA, 1410 nt, Artificial Sequence; identical to SEQ ID NO: 117149
  derived and/or modified sequence opt2 from neuraminidase__InfluenzaA__AIL93897

SEQ ID NO: 117163 - RNA, 1410 nt, Artificial Sequence
  derived and/or modified sequence opt2 from neuraminidase__InfluenzaA__AIL93909
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgucugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117164 - RNA, 1410 nt, Artificial Sequence; identical to SEQ ID NO: 117149
  derived and/or modified sequence opt2 from neuraminidase__InfluenzaA__AIL93920

SEQ ID NO: 117165 - RNA, 1410 nt, Artificial Sequence
  derived and/or modified sequence opt2 from neuraminidase__InfluenzaA__AIL93943
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117166 - RNA, 1410 nt, Artificial Sequence; identical to SEQ ID NO: 117149
  derived and/or modified sequence opt2 from neuraminidase__InfluenzaA__AIL93954

SEQ ID NO: 117167 - RNA, 1410 nt, Artificial Sequence; identical to SEQ ID NO: 117149
  derived and/or modified sequence opt2 from neuraminidase__InfluenzaA__AIL93966

SEQ ID NO: 117168 - RNA, 1410 nt, Artificial Sequence
  derived and/or modified sequence opt2 from neuraminidase__InfluenzaA__AIL93978
augaaccccaaccagaagaucaucaccaucggcuccgucucccucaccaucuccaccaucugccucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117169 - RNA, 1410 nt, Artificial Sequence; identical to SEQ ID NO: 117158
  derived and/or modified sequence opt2 from neuraminidase__InfluenzaA__AIL93990

SEQ ID NO: 117170 - RNA, 1410 nt, Artificial Sequence; identical to SEQ ID NO: 113658
  derived and/or modified sequence opt2 from neuraminidase__InfluenzaA__AIL94001

SEQ ID NO: 117171 - RNA, 1410 nt, Artificial Sequence; identical to SEQ ID NO: 117149
  derived and/or modified sequence opt2 from neuraminidase__InfluenzaA__AIL94013

SEQ ID NO: 117172 - RNA, 1410 nt, Artificial Sequence; identical to SEQ ID NO: 117149
  derived and/or modified sequence opt2 from neuraminidase__InfluenzaA__AIL94025

SEQ ID NO: 117173 - RNA, 1410 nt, Artificial Sequence; identical to SEQ ID NO: 117149
  derived and/or modified sequence opt2 from neuraminidase__InfluenzaA__AIL94037

SEQ ID NO: 117174 - RNA, 1410 nt, Artificial Sequence; identical to SEQ ID NO: 117149
  derived and/or modified sequence opt2 from neuraminidase__InfluenzaA__AIL94049

SEQ ID NO: 117175 - RNA, 1410 nt, Artificial Sequence; identical to SEQ ID NO: 117158
  derived and/or modified sequence opt2 from neuraminidase__InfluenzaA__AIL94061

SEQ ID NO: 117176 - RNA, 1410 nt, Artificial Sequence
  derived and/or modified sequence opt2 from neuraminidase__InfluenzaA__AIL94072
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccaccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccguccucuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucuggaucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117177 - RNA, 1410 nt, Artificial Sequence; identical to SEQ ID NO: 117158
  derived and/or modified sequence opt2 from neuraminidase__InfluenzaA__AIL94083

SEQ ID NO: 117178 - RNA, 1410 nt, Artificial Sequence; identical to SEQ ID NO: 117149
  derived and/or modified sequence opt2 from neuraminidase__InfluenzaA__AIL94238

SEQ ID NO: 117179 - RNA, 1410 nt, Artificial Sequence
  derived and/or modified sequence opt2 from neuraminidase__InfluenzaA__AIL94250
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117180 - RNA, 1410 nt, Artificial Sequence; identical to SEQ ID NO: 113658
  derived and/or modified sequence opt2 from neuraminidase__InfluenzaA__AIL94261

SEQ ID NO: 117181 - RNA, 1410 nt, Artificial Sequence; identical to SEQ ID NO: 113658
  derived and/or modified sequence opt2 from neuraminidase__InfluenzaA__AIL94273

SEQ ID NO: 117182 - RNA, 1410 nt, Artificial Sequence; identical to SEQ ID NO: 113658
  derived and/or modified sequence opt2 from neuraminidase__InfluenzaA__AIL94285

SEQ ID NO: 117183 - RNA, 1410 nt, Artificial Sequence
  derived and/or modified sequence opt2 from neuraminidase__InfluenzaA__AIL94297
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacacccgcacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117184 - RNA, 1410 nt, Artificial Sequence; identical to SEQ ID NO: 117149
  derived and/or modified sequence opt2 from neuraminidase__InfluenzaA__AIL94309

SEQ ID NO: 117185 - RNA, 1410 nt, Artificial Sequence; identical to SEQ ID NO: 117168
  derived and/or modified sequence opt2 from neuraminidase__InfluenzaA__AIL94321

SEQ ID NO: 117186 - RNA, 1410 nt, Artificial Sequence; identical to SEQ ID NO: 113658
  derived and/or modified sequence opt2 from neuraminidase__InfluenzaA__AIL94368

SEQ ID NO: 117187 - RNA, 1410 nt, Artificial Sequence
  derived and/or modified sequence opt2 from neuraminidase__InfluenzaA__AIL94380
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccgucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117188 - RNA, 1410 nt, Artificial Sequence
  derived and/or modified sequence opt2 from neuraminidase__InfluenzaA__AIL94392
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117189 - RNA, 1410 nt, Artificial Sequence
  derived and/or modified sequence opt2 from neuraminidase__InfluenzaA__AIL94403
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcgaccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117190 - RNA, 1410 nt, Artificial Sequence; identical to SEQ ID NO: 113658
  derived and/or modified sequence opt2 from neuraminidase__InfluenzaA__AIL94426

SEQ ID NO: 117191 - RNA, 1410 nt, Artificial Sequence
  derived and/or modified sequence opt2 from neuraminidase__InfluenzaA__AIL94438
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccaccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccgucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117192 - RNA, 1410 nt, Artificial Sequence
  derived and/or modified sequence opt2 from neuraminidase__InfluenzaA__AIL94449
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccaaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuacuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117193 - RNA, 1410 nt, Artificial Sequence; identical to SEQ ID NO: 117187
  derived and/or modified sequence opt2 from neuraminidase__InfluenzaA__AIL94461

SEQ ID NO: 117194 - RNA, 1410 nt, Artificial Sequence
  derived and/or modified sequence opt2 from neuraminidase__InfluenzaA__AIL94473
augaaccccaaccagaagaucaucaccaucggcuccgucugcaugaccaucggcauggccaaccucauccuccagaucggcaacaucaucuccaucugggucggccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacacccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaucgucggcugguccuggcccgacggcgccgagcuccccuucaccaucgacaaguga

SEQ ID NO: 117195 - RNA, 1410 nt, Artificial Sequence; identical to SEQ ID NO: 116248
  derived and/or modified sequence opt2 from neuraminidase__InfluenzaA__AIL94484

SEQ ID NO: 117196 - RNA, 1410 nt, Artificial Sequence; identical to SEQ ID NO: 117158
  derived and/or modified sequence opt2 from neuraminidase__InfluenzaA__AIL94507

SEQ ID NO: 117197 - RNA, 1410 nt, Artificial Sequence
  derived and/or modified sequence opt2 from neuraminidase__InfluenzaA__AIL94518
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucucccucaugcccaucuga

SEQ ID NO: 117198 - RNA, 1410 nt, Artificial Sequence
  derived and/or modified sequence opt2 from neuraminidase__InfluenzaA__AIL94530
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117199 - RNA, 1410 nt, Artificial Sequence; identical to SEQ ID NO: 117188
  derived and/or modified sequence opt2 from neuraminidase__InfluenzaA__AIL94542

SEQ ID NO: 117200 - RNA, 1410 nt, Artificial Sequence; identical to SEQ ID NO: 117158
  derived and/or modified sequence opt2 from neuraminidase__InfluenzaA__AIL94553

SEQ ID NO: 117201 - RNA, 1410 nt, Artificial Sequence; identical to SEQ ID NO: 117149
  derived and/or modified sequence opt2 from neuraminidase__InfluenzaA__AIL94564

SEQ ID NO: 117202 - RNA, 1410 nt, Artificial Sequence; identical to SEQ ID NO: 117158
  derived and/or modified sequence opt2 from neuraminidase__InfluenzaA__AIL94576

SEQ ID NO: 117203 - RNA, 1410 nt, Artificial Sequence
  derived and/or modified sequence opt2 from neuraminidase__InfluenzaA__AIL94587
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagauggacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaacggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccggcggcuccuccaucuccuucugcggcgucaacuccgacaccgucggcugguccuggcccgacggcgccgagcuccccuucaccaucgacaaguga

SEQ ID NO: 117204 - RNA, 1410 nt, Artificial Sequence; identical to SEQ ID NO: 117188
  derived and/or modified sequence opt2 from neuraminidase__InfluenzaA__AIL94598

SEQ ID NO: 117205 - RNA, 1410 nt, Artificial Sequence
  derived and/or modified sequence opt2 from neuraminidase__InfluenzaA__AIL94609
augaaccccaaccagaagaucaucaccaucggcuccgucucccucaccaucuccaccaucugccucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucauguccgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccucuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117206 - RNA, 1410 nt, Artificial Sequence
  derived and/or modified sequence opt2 from neuraminidase__InfluenzaA__AIL94621
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117207 - RNA, 1410 nt, Artificial Sequence; identical to SEQ ID NO: 117158
  derived and/or modified sequence opt2 from neuraminidase__InfluenzaA__AIL94632

SEQ ID NO: 117208 - RNA, 1410 nt, Artificial Sequence; identical to SEQ ID NO: 113658
  derived and/or modified sequence opt2 from neuraminidase__InfluenzaA__AIL94643

SEQ ID NO: 117209 - RNA, 1410 nt, Artificial Sequence
  derived and/or modified sequence opt2 from neuraminidase__InfluenzaA__AIL94655
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117210 - RNA, 1410 nt, Artificial Sequence
  derived and/or modified sequence opt2 from neuraminidase__InfluenzaA__AIL94677
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117211 - RNA, 1410 nt, Artificial Sequence; identical to SEQ ID NO: 117149
  derived and/or modified sequence opt2 from neuraminidase__InfluenzaA__AIL94688

SEQ ID NO: 117212 - RNA, 1410 nt, Artificial Sequence
  derived and/or modified sequence opt2 from neuraminidase__InfluenzaA__AIL94700
augaaccccaaccagaagaucaucaccaucggcuccgucucccucaccaucuccaccaucugcuucuucaugcagaucgccauccucaucaccaucgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacaucgaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117213 - RNA, 1410 nt, Artificial Sequence; identical to SEQ ID NO: 117158
  derived and/or modified sequence opt2 from neuraminidase__InfluenzaA__AIL94712

SEQ ID NO: 117214 - RNA, 1410 nt, Artificial Sequence; identical to SEQ ID NO: 117188
  derived and/or modified sequence opt2 from neuraminidase__InfluenzaA__AIL94723

SEQ ID NO: 117215 - RNA, 1410 nt, Artificial Sequence
  derived and/or modified sequence opt2 from neuraminidase__InfluenzaA__AIL94734
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacgagcacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117216 - RNA, 1410 nt, Artificial Sequence; identical to SEQ ID NO: 117158
  derived and/or modified sequence opt2 from neuraminidase__InfluenzaA__AIL94746

SEQ ID NO: 117217 - RNA, 1410 nt, Artificial Sequence; identical to SEQ ID NO: 117188
  derived and/or modified sequence opt2 from neuraminidase__InfluenzaA__AIL94757

SEQ ID NO: 117218 - RNA, 1410 nt, Artificial Sequence; identical to SEQ ID NO: 117149
  derived and/or modified sequence opt2 from neuraminidase__InfluenzaA__AIL94768

SEQ ID NO: 117219 - RNA, 1410 nt, Artificial Sequence; identical to SEQ ID NO: 113658
  derived and/or modified sequence opt2 from neuraminidase__InfluenzaA__AIL94780

SEQ ID NO: 117220 - RNA, 1410 nt, Artificial Sequence; identical to SEQ ID NO: 117188
  derived and/or modified sequence opt2 from neuraminidase__InfluenzaA__AIL94803

SEQ ID NO: 117221 - RNA, 1410 nt, Artificial Sequence; identical to SEQ ID NO: 117168
  derived and/or modified sequence opt2 from neuraminidase__InfluenzaA__AIL94814

SEQ ID NO: 117222 - RNA, 1410 nt, Artificial Sequence
  derived and/or modified sequence opt2 from neuraminidase__InfluenzaA__AIL94826
augaaccccaaccagaagaucaucaccaucggcuccgucucccucaccaucuccaccaucugcuucuucaugcagaucgccauccucaucaccaccgucacccuccacuucaagcaguacgaguucaacucccuccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117223 - RNA, 1410 nt, Artificial Sequence
  derived and/or modified sequence opt2 from neuraminidase__InfluenzaA__AIL94850
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucuucgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacuccgaggagggcggccacggcgucaagggcugggccuucgacgacggcaacgacgucuggaugggccgcaccaucuccgagaagucccgccucggcuacgagaccuucaaggucaucgagggcugguccaaccccaaguccaaguuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117224 - RNA, 1410 nt, Artificial Sequence; identical to SEQ ID NO: 110922
  derived and/or modified sequence opt2 from neuraminidase__InfluenzaA__AIL94862

SEQ ID NO: 117225 - RNA, 1410 nt, Artificial Sequence; identical to SEQ ID NO: 110922
  derived and/or modified sequence opt2 from neuraminidase__InfluenzaA__AIL94874

SEQ ID NO: 117226 - RNA, 1410 nt, Artificial Sequence
  derived and/or modified sequence opt2 from neuraminidase__InfluenzaA__AIL94886
augaaccccaaccagaagaucaucaccaucggcuccgucugcaugaccaucggcauggccaaccucaugcuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagaucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacgacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcccccacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117227 - RNA, 1410 nt, Artificial Sequence; identical to SEQ ID NO: 114434
  derived and/or modified sequence opt2 from neuraminidase__InfluenzaA__AIL94897

SEQ ID NO: 117228 - RNA, 1410 nt, Artificial Sequence; identical to SEQ ID NO: 117222
  derived and/or modified sequence opt2 from neuraminidase__InfluenzaA__AIL94909

SEQ ID NO: 117229 - RNA, 1410 nt, Artificial Sequence; identical to SEQ ID NO: 113658
  derived and/or modified sequence opt2 from neuraminidase__InfluenzaA__AIL94921

SEQ ID NO: 117230 - RNA, 1410 nt, Artificial Sequence; identical to SEQ ID NO: 113658
  derived and/or modified sequence opt2 from neuraminidase__InfluenzaA__AIL94933

SEQ ID NO: 117231 - RNA, 1410 nt, Artificial Sequence; identical to SEQ ID NO: 117149
  derived and/or modified sequence opt2 from neuraminidase__InfluenzaA__AIL94945

SEQ ID NO: 117232 - RNA, 1410 nt, Artificial Sequence
  derived and/or modified sequence opt2 from neuraminidase__InfluenzaA__AIL94957
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagauggacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaacggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117233 - RNA, 1410 nt, Artificial Sequence; identical to SEQ ID NO: 117222
  derived and/or modified sequence opt2 from neuraminidase__InfluenzaA__AIL94968

SEQ ID NO: 117234 - RNA, 1410 nt, Artificial Sequence
  derived and/or modified sequence opt2 from neuraminidase__InfluenzaA__AIM55840
augaaccccaaccagaagaucaucaccaucggcuccgucugcaugaccaucggcauggccaaccucauccuccagaucggcaacaucaucuccaucuggaucucccacuccauccaggucggcaaccagucccagaucgagaucugcaaccaguccgucaucaccuacgagaacaacaccugggucaaccagaccuacgucaacaucuccaacaccaacuucgccgccggccagcccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacgacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuucgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117235 - RNA, 1410 nt, Artificial Sequence
  derived and/or modified sequence opt2 from neuraminidase__InfluenzaA__AIM55851
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggccgcaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaaguccgacaccgucggcugguccuggcccgacggcgccgagcuccccuucaccaucgacaaguga

SEQ ID NO: 117236 - RNA, 1410 nt, Artificial Sequence
  derived and/or modified sequence opt2 from neuraminidase__InfluenzaA__AIM55862
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaacggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117237 - RNA, 1410 nt, Artificial Sequence
  derived and/or modified sequence opt2 from neuraminidase__InfluenzaA__AIM55873
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117238 - RNA, 1410 nt, Artificial Sequence; identical to SEQ ID NO: 117237
  derived and/or modified sequence opt2 from neuraminidase__InfluenzaA__AIM55884

SEQ ID NO: 117239 - RNA, 1410 nt, Artificial Sequence; identical to SEQ ID NO: 117237
  derived and/or modified sequence opt2 from neuraminidase__InfluenzaA__AIM55918

SEQ ID NO: 117240 - RNA, 1410 nt, Artificial Sequence
  derived and/or modified sequence opt2 from neuraminidase__InfluenzaA__AIM55929
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaccggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117241 - RNA, 1410 nt, Artificial Sequence
  derived and/or modified sequence opt2 from neuraminidase__InfluenzaA__AIM55940
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccuccaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117242 - RNA, 1410 nt, Artificial Sequence
  derived and/or modified sequence opt2 from neuraminidase__InfluenzaA__AIM55965
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacgccgucggcugguccuggcccgacggcgccgagcuccccuucaccaucgacaaguga

SEQ ID NO: 117243 - RNA, 1410 nt, Artificial Sequence
  derived and/or modified sequence opt2 from neuraminidase__InfluenzaA__AIM55976
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117244 - RNA, 1410 nt, Artificial Sequence
  derived and/or modified sequence opt2 from neuraminidase__InfluenzaA__AIM55987
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaccggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucgacugguccuggcccgacggcgccgagcuccccuucaccaucgacaaguga

SEQ ID NO: 117245 - RNA, 1410 nt, Artificial Sequence
  derived and/or modified sequence opt2 from neuraminidase__InfluenzaA__AIM55998
augaaccccaaccagaagaucaucaccaucggcuccgucugcaugaccaucggcauggccaaccucauccuccagaucggcaacaccaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaaguccgacaccgucggcugguccuggcccgacggcgccgagcuccccuucaccaucgacaaguga

SEQ ID NO: 117246 - RNA, 1410 nt, Artificial Sequence; identical to SEQ ID NO: 117243
  derived and/or modified sequence opt2 from neuraminidase__InfluenzaA__AIM56009

SEQ ID NO: 117247 - RNA, 1410 nt, Artificial Sequence; identical to SEQ ID NO: 117243
  derived and/or modified sequence opt2 from neuraminidase__InfluenzaA__AIM56020

SEQ ID NO: 117248 - RNA, 1410 nt, Artificial Sequence; identical to SEQ ID NO: 117243
  derived and/or modified sequence opt2 from neuraminidase__InfluenzaA__AIM56031

SEQ ID NO: 117249 - RNA, 1410 nt, Artificial Sequence
  derived and/or modified sequence opt2 from neuraminidase__InfluenzaA__AIM56042
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117250 - RNA, 1410 nt, Artificial Sequence
  derived and/or modified sequence opt2 from neuraminidase__InfluenzaA__AIM56053
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacgagcaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117251 - RNA, 1410 nt, Artificial Sequence
  derived and/or modified sequence opt2 from neuraminidase__InfluenzaA__AIM56064
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucguccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117252 - RNA, 1410 nt, Artificial Sequence
  derived and/or modified sequence opt2 from neuraminidase__InfluenzaA__AIM56086
augaaccccaaccagaagaucaucaccaucggcuccgucugcaugaccaucggcauggccaaccucauccuccagaucggcaacaucaucuccaucugggucucccacuccauccagcucggcaaccagucccacaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucaccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117253 - RNA, 1410 nt, Artificial Sequence
  derived and/or modified sequence opt2 from neuraminidase__InfluenzaA__AIM56097
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccgagcaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117254 - RNA, 1410 nt, Artificial Sequence
  derived and/or modified sequence opt2 from neuraminidase__InfluenzaA__AIM56108
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccuggaucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117255 - RNA, 1410 nt, Artificial Sequence
  derived and/or modified sequence opt2 from neuraminidase__InfluenzaA__AIM56119
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117256 - RNA, 1410 nt, Artificial Sequence
  derived and/or modified sequence opt2 from neuraminidase__InfluenzaA__AIM56130
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaaguccgacaccgucggcugguccuggcccgacggcgccgagcuccccuucaccaucgacaaguga

SEQ ID NO: 117257 - RNA, 1410 nt, Artificial Sequence
  derived and/or modified sequence opt2 from neuraminidase__InfluenzaA__AIM56141
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaucuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117258 - RNA, 1410 nt, Artificial Sequence; identical to SEQ ID NO: 117243
  derived and/or modified sequence opt2 from neuraminidase__InfluenzaA__AIM56152

SEQ ID NO: 117259 - RNA, 1410 nt, Artificial Sequence
  derived and/or modified sequence opt2 from neuraminidase__InfluenzaA__AIM56163
augaaccccaaccagaagaucaucaccaucggcuccgucugcaugaccaucggcauggccaaccucauccuccagaucggcaacaucaucuccaucugggucucccacuccauccagcucggcaaccagucccacaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucaccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117260 - RNA, 1410 nt, Artificial Sequence
  derived and/or modified sequence opt2 from neuraminidase__InfluenzaA__AIM56174
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccgucgacaaguga

SEQ ID NO: 117261 - RNA, 1410 nt, Artificial Sequence; identical to SEQ ID NO: 117256
  derived and/or modified sequence opt2 from neuraminidase__InfluenzaA__AIM56185

SEQ ID NO: 117262 - RNA, 1410 nt, Artificial Sequence; identical to SEQ ID NO: 117255
  derived and/or modified sequence opt2 from neuraminidase__InfluenzaA__AIM56196

SEQ ID NO: 117263 - RNA, 1410 nt, Artificial Sequence; identical to SEQ ID NO: 117237
  derived and/or modified sequence opt2 from neuraminidase__InfluenzaA__AIM56207

SEQ ID NO: 117264 - RNA, 1410 nt, Artificial Sequence
  derived and/or modified sequence opt2 from neuraminidase__InfluenzaA__AIM56229
augaaccccaaccagaagaucaucaccaucggcuccgucugcaugaccaucggcauggccaaccucauccuccagaucggcaacaccaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccacgccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117265 - RNA, 1410 nt, Artificial Sequence
  derived and/or modified sequence opt2 from neuraminidase__InfluenzaA__AIM56240
augaaccccaaccagaagaucaucaccaucggcuccgucugcaugaccaucggcauggccaaccucauccuccagaucggcaacaucaucuccaucuggaucucccacuccauccaggucggcaaccagucccagaucgagaccugcaaccaguccgucaucaccuacgagaacaacaccugggucaaccagaccuacgucaacaucuccaacaccaacuucgccgccggccagcccgucgucuccgucaagcucgccggcaacuccucccucugcuccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacgacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117266 - RNA, 1410 nt, Artificial Sequence
  derived and/or modified sequence opt2 from neuraminidase__InfluenzaA__AIM56251
augaaccccaaccagaagaucaucaccaucggcuccgucugcaugaccaucggcauggccaaccucauccuccagaucggcaacaucaucuccaucugggucucccacuccauccagcucggcaaccagucccacaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117267 - RNA, 1410 nt, Artificial Sequence; identical to SEQ ID NO: 117266
  derived and/or modified sequence opt2 from neuraminidase__InfluenzaA__AIM56262

SEQ ID NO: 117268 - RNA, 1410 nt, Artificial Sequence; identical to SEQ ID NO: 117237
  derived and/or modified sequence opt2 from neuraminidase__InfluenzaA__AIM56273

SEQ ID NO: 117269 - RNA, 1410 nt, Artificial Sequence
  derived and/or modified sequence opt2 from neuraminidase__InfluenzaA__AIM56284
augaaccccaaccagaagaucaucaccaucggcuccgucugcaucaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacgucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117270 - RNA, 1410 nt, Artificial Sequence; identical to SEQ ID NO: 117237
  derived and/or modified sequence opt2 from neuraminidase__InfluenzaA__AIM56295

SEQ ID NO: 117271 - RNA, 1410 nt, Artificial Sequence; identical to SEQ ID NO: 117237
  derived and/or modified sequence opt2 from neuraminidase__InfluenzaA__AIM56306

SEQ ID NO: 117272 - RNA, 1410 nt, Artificial Sequence; identical to SEQ ID NO: 117237
  derived and/or modified sequence opt2 from neuraminidase__InfluenzaA__AIM56317

SEQ ID NO: 117273 - RNA, 1410 nt, Artificial Sequence; identical to SEQ ID NO: 117256
  derived and/or modified sequence opt2 from neuraminidase__InfluenzaA__AIM56339

SEQ ID NO: 117274 - RNA, 1410 nt, Artificial Sequence
  derived and/or modified sequence opt2 from neuraminidase__InfluenzaA__AIM56350
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcaucaacuccgacaccgucggcugguccuggcccgacggcgccgagcuccccuucaccaucgacaaguga

SEQ ID NO: 117275 - RNA, 1410 nt, Artificial Sequence; identical to SEQ ID NO: 117266
  derived and/or modified sequence opt2 from neuraminidase__InfluenzaA__AIM56361

SEQ ID NO: 117276 - RNA, 1410 nt, Artificial Sequence; identical to SEQ ID NO: 117237
  derived and/or modified sequence opt2 from neuraminidase__InfluenzaA__AIM56372

SEQ ID NO: 117277 - RNA, 1410 nt, Artificial Sequence; identical to SEQ ID NO: 117266
  derived and/or modified sequence opt2 from neuraminidase__InfluenzaA__AIM56383

SEQ ID NO: 117278 - RNA, 1410 nt, Artificial Sequence
  derived and/or modified sequence opt2 from neuraminidase__InfluenzaA__AIM56394
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117279 - RNA, 1410 nt, Artificial Sequence; identical to SEQ ID NO: 117255
  derived and/or modified sequence opt2 from neuraminidase__InfluenzaA__AIM56405

SEQ ID NO: 117280 - RNA, 1410 nt, Artificial Sequence
  derived and/or modified sequence opt2 from neuraminidase__InfluenzaA__AIM56416
augaaccccaaccagaagaucaucaccaucggcuccgucugcaugaccaucggcauggccaaccucauccuccagaucggcaacaucaucuccaucugggucucccacuccauccagcucggcaaccagucccacaucgagaccugcaaccaguccgucaucaccuacgagaacaacaccugggucaaccagaccuacgucaacaucuccaacaucaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucaccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117281 - RNA, 1410 nt, Artificial Sequence; identical to SEQ ID NO: 117255
  derived and/or modified sequence opt2 from neuraminidase__InfluenzaA__AIM56428

SEQ ID NO: 117282 - RNA, 1410 nt, Artificial Sequence; identical to SEQ ID NO: 117237
  derived and/or modified sequence opt2 from neuraminidase__InfluenzaA__AIM56439

SEQ ID NO: 117283 - RNA, 1410 nt, Artificial Sequence
  derived and/or modified sequence opt2 from neuraminidase__InfluenzaA__AIM56450
augaaccccaaccagaagaucaucaccaucggcuccgucugcaugaccaucggcauggccaaccucauccuccagaucggcaacaucaucuccaucuggaucucccacuccauccaggucggcaaccagucccagaucgagaccugcaaccaguccgucaucaccuacgagaacaacaccugggucaaccagaccuacgucaacaucuccaacaccaacuucgccgccggccagcccgucgucuccgucaagcucgccggcaacuccucccucugccccgucuccggcugggccaucuacuccaaggacaacuccguccgcgucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacgacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguacaagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccgucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117284 - RNA, 1410 nt, Artificial Sequence
  derived and/or modified sequence opt2 from neuraminidase__InfluenzaA__AIM56461
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcgucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117285 - RNA, 1410 nt, Artificial Sequence
  derived and/or modified sequence opt2 from neuraminidase__InfluenzaA__AIM56472
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugcaacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117286 - RNA, 1410 nt, Artificial Sequence; identical to SEQ ID NO: 117243
  derived and/or modified sequence opt2 from neuraminidase__InfluenzaA__AIM56483

SEQ ID NO: 117287 - RNA, 1410 nt, Artificial Sequence; identical to SEQ ID NO: 117266
  derived and/or modified sequence opt2 from neuraminidase__InfluenzaA__AIM56494

SEQ ID NO: 117288 - RNA, 1410 nt, Artificial Sequence; identical to SEQ ID NO: 117256
  derived and/or modified sequence opt2 from neuraminidase__InfluenzaA__AIM56505

SEQ ID NO: 117289 - RNA, 1410 nt, Artificial Sequence; identical to SEQ ID NO: 117255
  derived and/or modified sequence opt2 from neuraminidase__InfluenzaA__AIM56516

SEQ ID NO: 117290 - RNA, 1410 nt, Artificial Sequence
  derived and/or modified sequence opt2 from neuraminidase__InfluenzaA__AIM56527
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccgagcaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcguccucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagauggucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117291 - RNA, 1410 nt, Artificial Sequence; identical to SEQ ID NO: 117237
  derived and/or modified sequence opt2 from neuraminidase__InfluenzaA__AIM56538

SEQ ID NO: 117292 - RNA, 1410 nt, Artificial Sequence
  derived and/or modified sequence opt2 from neuraminidase__InfluenzaA__AIM56549
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgaggucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117293 - RNA, 1410 nt, Artificial Sequence
  derived and/or modified sequence opt2 from neuraminidase__InfluenzaA__AIM56560
augaaccccaaccagaagaucaucaccaucggcuccgucugcaugaccaucggcauggccaaccucauccuccagaucggcaacaucaucuccaucugggucucccacuccauccagcucggcaaccagucccacaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccauccacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucaccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117294 - RNA, 1410 nt, Artificial Sequence; identical to SEQ ID NO: 117243
  derived and/or modified sequence opt2 from neuraminidase__InfluenzaA__AIM56571

SEQ ID NO: 117295 - RNA, 1410 nt, Artificial Sequence
  derived and/or modified sequence opt2 from neuraminidase__InfluenzaA__AIM56582
augaaccccaaccagaagaucaucaccaucggcuccgucugcaucaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117296 - RNA, 1410 nt, Artificial Sequence
  derived and/or modified sequence opt2 from neuraminidase__InfluenzaA__AIM56593
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccgagcaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcguccucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccgagaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117297 - RNA, 1410 nt, Artificial Sequence
  derived and/or modified sequence opt2 from neuraminidase__InfluenzaA__AIM56604
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaucaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117298 - RNA, 1410 nt, Artificial Sequence
  derived and/or modified sequence opt2 from neuraminidase__InfluenzaA__AIM56615
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucgacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacuccaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117299 - RNA, 1410 nt, Artificial Sequence; identical to SEQ ID NO: 117292
  derived and/or modified sequence opt2 from neuraminidase__InfluenzaA__AIM56626

SEQ ID NO: 117300 - RNA, 1410 nt, Artificial Sequence; identical to SEQ ID NO: 117237
  derived and/or modified sequence opt2 from neuraminidase__InfluenzaA__AIM56637

SEQ ID NO: 117301 - RNA, 1410 nt, Artificial Sequence; identical to SEQ ID NO: 117243
  derived and/or modified sequence opt2 from neuraminidase__InfluenzaA__AIM56648

SEQ ID NO: 117302 - RNA, 1410 nt, Artificial Sequence
  derived and/or modified sequence opt2 from neuraminidase__InfluenzaA__AIM56659
augaaccccaaccagaagaucaucaccaucggcuccgucugcaugaccaucggcauggccaaccucauccuccagaucggcaacaucaucuccaucugggucucccacuccauccagcucggcaaccagucccacaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaucggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaagaccaucuggaccuccggcuccuccaucuccuucugcggcgucaacuccgacaccgucggcugguccuggcccgacggcgccgagcuccccuucaccaucgacaaguga

SEQ ID NO: 117303 - RNA, 1410 nt, Artificial Sequence
  derived and/or modified sequence opt2 from neuraminidase__InfluenzaA__AIM56670
augaaccccaaccagaagaucaucaccaucggcuccgucugcaugaccaucggcauggccaaccucauccuccagaucggcaacaccaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117304 - RNA, 1410 nt, Artificial Sequence; identical to SEQ ID NO: 117255
  derived and/or modified sequence opt2 from neuraminidase__InfluenzaA__AIM56703

SEQ ID NO: 117305 - RNA, 1410 nt, Artificial Sequence
  derived and/or modified sequence opt2 from neuraminidase__InfluenzaA__AIM56714
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccguccccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117306 - RNA, 1410 nt, Artificial Sequence
  derived and/or modified sequence opt2 from neuraminidase__InfluenzaA__AIM56725
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgaggucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117307 - RNA, 1410 nt, Artificial Sequence; identical to SEQ ID NO: 117255
  derived and/or modified sequence opt2 from neuraminidase__InfluenzaA__AIM56736

SEQ ID NO: 117308 - RNA, 1410 nt, Artificial Sequence
  derived and/or modified sequence opt2 from neuraminidase__InfluenzaA__AIM56747
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccucccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117309 - RNA, 1410 nt, Artificial Sequence; identical to SEQ ID NO: 117292
  derived and/or modified sequence opt2 from neuraminidase__InfluenzaA__AIM56758

SEQ ID NO: 117310 - RNA, 1410 nt, Artificial Sequence; identical to SEQ ID NO: 117255
  derived and/or modified sequence opt2 from neuraminidase__InfluenzaA__AIM56769

SEQ ID NO: 117311 - RNA, 1410 nt, Artificial Sequence
  derived and/or modified sequence opt2 from neuraminidase__InfluenzaA__AIM56780
augaaccccaaccagaagaucaucaccaucggcuccgucugcaugaccaucggcauggccaaccucauccuccagaucggcaacaucaucuccaucugggucucccacuccauccagcucggcaaccagucccagaucggcaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcauccacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117312 - RNA, 1410 nt, Artificial Sequence
  derived and/or modified sequence opt2 from neuraminidase__InfluenzaA__AIM56791
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117313 - RNA, 1410 nt, Artificial Sequence
  derived and/or modified sequence opt2 from neuraminidase__InfluenzaA__AIM56813
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacuccaaguucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117314 - RNA, 1410 nt, Artificial Sequence
  derived and/or modified sequence opt2 from neuraminidase__InfluenzaA__AIM56824
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccguccccuccaacggcgccaacggcgucaagggcuucuccuucaaguacuccaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117315 - RNA, 1398 nt, Artificial Sequence
  derived and/or modified sequence opt2 from neuraminidase__InfluenzaA__AIN76385
augaaccccaaccagaagauccucugcaccuccgccaccgccaucaucaucggcgccaucgccguccucaucggcaucgccaaccucggccucaacaucggccuccaccucaagcccggcugcaacugcucccacucccagcccggcaccaccaacaccucccagaccaucaucaacaacuacuacaacgagaccaacaucaccaacauccagauggaggagcgcaccucccgcaacuucaacucccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcaucugccccaucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugcaaggacaacuggcagggcuccaaccgccccgucauccagaucgaccccgucgccaugacccacaccucccaguacaucugcucccccguccucaccgacaccccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgcccgcaucgaguacuuccucuga

SEQ ID NO: 117316 - RNA, 1410 nt, Artificial Sequence; identical to SEQ ID NO: 105599
  derived and/or modified sequence opt2 from neuraminidase__InfluenzaA__AIP93105

SEQ ID NO: 117317 - RNA, 1410 nt, Artificial Sequence
  derived and/or modified sequence opt2 from neuraminidase__InfluenzaA__AIP93117
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 117318 - RNA, 1410 nt, Artificial Sequence
  derived and/or modified sequence opt2 from neuraminidase__InfluenzaA__AIR93973
augaaccccaaccagaagaucaucaccaucggcuccgucugcaugaccaucggcauggccaaccucauccuccagaucggcaacaucaucuccaucuggaucucccacuccauccagcucggcucccgcaaccagaucgaggccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccaacaccgucggcugguccuggcccgacggcgccgagcuccccuucaccaucgacaaguga

SEQ ID NO: 117319 - RNA, 1410 nt, Artificial Sequence
  derived and/or modified sequence opt2 from neuraminidase__InfluenzaA__AIR93984
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucggcugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117320 - RNA, 1410 nt, Artificial Sequence
  derived and/or modified sequence opt2 from neuraminidase__InfluenzaA__AIR93995
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggaagaacaacauccuccgcacccaggaguccgagugcgucugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117321 - RNA, 1401 nt, Artificial Sequence
  derived and/or modified sequence opt2 from neuraminidase__InfluenzaA__AIR94118
augaaccccaaccagaagaucaucgccaucggcuccgucucccucaucaucgccaucaucugccuccucaugcagaucgccauccucaccaccaccaugacccuccacuuccgccagaacgagugcaacaacuccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacaacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucaucaaggagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugcaaggaccccaacuccgagcgcggcgcccccggcgucaagggcugggccuucgacgacggcaacgacgucuggaugggccgcaccaucaagaacggcucccgcuccggcuacgagaccuuccgcgucgucaacggcuggaccgucgccaacuccaagucccaggucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 117322 - RNA, 1410 nt, Artificial Sequence
  derived and/or modified sequence opt2 from neuraminidase__InfluenzaA__AIT38335
augaaccccaaccagaagaucaucaccaucggcuccgucucccucaccaucgccaccaucugcuuccucaugcagaucgccauccucgucaccaccgucacccuccacuucaagcaguacgagugcaacuccccccccaccaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcauccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagcgcauccuccgcacccaggaguccgagugcgucugcaucgacggcaccugcaccgucgucaugaccgacggcuccgccuccggccgcgccgacacccgcauccucuucaucaaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucaacuccuccuacgucugcuccggccucgucggcgacaccccccgcaagaacgacuccuucuccuccuccuacugccucaaccccaacaacgaggagggcggccacggcgucaagggcugggccuucgacgacggcgacgacgucuggaugggccgcaccaucaacgagaagcuccgcuccggcuacgagaccuucaaggucaucaagggcugguccaagcccaacuccaagcuccagaucaaccgccaggucaucgucgaccgcggcaaccgcuccggcuacuccggcaucuucuccgucgagggcaagggcugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccaacaucaaccucaugcccaucuga

SEQ ID NO: 117323 - RNA, 1410 nt, Artificial Sequence
  derived and/or modified sequence opt2 from neuraminidase__InfluenzaA__AIT38346
augaaccccaaccagaagaucaucaccaucggcuccaucucccucaccaucgccaccaucugcuuccuccuccaggucgccauccucgucaccaccgucacccuccacuucaagcaguucgagugcaaccccacccccaacaaccaggucaugcucugcgagcccaccgucaucgagcgcaacaucaccaagaucgucuaccucaccaacaccaccgucgagaaggagaucugccccaagcccgccgaguaccgcaacugguccaagccccagugcaagaucaccggcuucgcccccuucuccaaggacaacuccauccgccucuccgccggcggcgacaucugggucacccgcgagcccuacgucuccugcgcccccaacaagugcuaccaguucgcccucggccagggcaccacccucaacaaccgccacuccaacgacaccguccacgaccgcacccccuaccgcacccuccucaugaacgagcucggcauccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucaaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacguccgcgacuacuccaucgucuccuccuacgucugcuccggccucgucggcgacaccccccgcaagaacgacuccuucuccuccucccacugccucaaccccaacaacgaggagggcggccacggcgucaagggcugggccuucgacgacggcgacgacgucuggaugggccgcaccaucuccgagaagcuccgcuccggcuacgagaccuucaaggucaucaagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 117324 - RNA, 1410 nt, Artificial Sequence
  derived and/or modified sequence opt2 from neuraminidase__InfluenzaA__AIT38361
augaaccccaaccagaagaucaucaccaucggcuccaucucccucaccaucgccaccaucugcuuccucaugcaggucgccauccucgucaccaccgucacccuccacuucaagcaguacgagugcaacuccacccccaacaaccaggucaugcucugcgagcccaccgucaucgagcgcaacaucaccaagaucgucuaccucaccaacaccaccgucgucaaggaggucugccccaagcccgccgaguaccgcaacugguccaagccccagugcaagaucaccggcuucgcccccuucuccaaggacaacuccauccgccucuccgccggcggcgacaucugggucacccgcgagcccuacgucuccugcgcccccaacaagugcuaccaguucgcccucggccagggcaccacccucaacaaccgccacuccaacgacaccguccacgaccgcacccccuaccgcacccuccucaugaacgagcucggcauccccuuccaccucggcaccaagcaggucugcaucgccugguccuccuccuccugcuacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucaaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacaugcgcgacuacuccaucgucuccuccuacgucugcuccggccucgucggcgacaccccccgcgagaacgacuccuucuccuccucccacugccucaaccccaacaacgaggagggcggccacggcgucaagggcugggccuucgacgacggcgacgacgucuggaugggccgcaccaucuccgagaagcuccgcuccggcuacgagaccuucaaggucaucaagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 117325 - RNA, 1410 nt, Artificial Sequence
  derived and/or modified sequence opt2 from neuraminidase__InfluenzaA__AIT38375
augaaccccaaccagaagaucaucaccaucggcuccgucugcaugaccaucggcauggucaaccucauccuccagaucggcaacaucaucuccaucuggaucucccacuccauccagcucggcaaccagaaccagaucgagaucugcaaccaguccgucaucaccuacgagaacaacaccugggucaaccagaccuacgucaacaucuccaacaccaacuucgccgccggccaguccgucguccccgucaagcucgccggcaacuccucccucugcuccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117326 - RNA, 1410 nt, Artificial Sequence
  derived and/or modified sequence opt2 from neuraminidase__InfluenzaA__AIT93148
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117327 - RNA, 1410 nt, Artificial Sequence; identical to SEQ ID NO: 110152
  derived and/or modified sequence opt2 from neuraminidase__InfluenzaA__AIU39701

SEQ ID NO: 117328 - RNA, 1410 nt, Artificial Sequence; identical to SEQ ID NO: 108250
  derived and/or modified sequence opt2 from neuraminidase__InfluenzaA__AIU39703

SEQ ID NO: 117329 - RNA, 1410 nt, Artificial Sequence
  derived and/or modified sequence opt2 from neuraminidase__InfluenzaA__AIU39705
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaacaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117330 - RNA, 1413 nt, Artificial Sequence
  derived and/or modified sequence opt2 from neuraminidase__InfluenzaA__AIU46611
augaaccccaaccagaagaucaccugcaucuccgccaccggcaugacccucuccgucgucuccaugcucaucggcaucgccaaccucggccucaacaucggccuccacuacaaggucggcgacuccaccaacaucaacauccccaacaugaacgagaccucccccaccaccaccaucaucaacaaccacccccagaacaacuucaccaacaucaccaacaucaucgucacccgcaacgaggagggccaccuccucaaccucaccaagccccucugcgaggucaacuccuggcacauccucuccaaggacaacgccauccgcaucggcgaggacgcccacaucaucgucacccgcgagcccuaccucuccugcgacccccagggcugccgcauguucgcccucucccagggcaccacccuccgcggcaagcacgccaacggcaccauccacgaccgcucccccuuccgcgcccucgucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagaucaagaagaucgaggagcucaagggcgacgcccagcacaucgaggagugcuccugcuacggcgccuccgagaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaacugcgaggcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcuccaaggagcgccucggcuccugguccuggcacgacggcgccgagaucaucuacuucaaguga

SEQ ID NO: 117331 - RNA, 1410 nt, Artificial Sequence
  derived and/or modified sequence opt2 from neuraminidase__InfluenzaA__AIV09221
augaaccccaaccagaagaucaucaccaucggcuccgucugcaugaccaucggcauggccaaccucauccuccagaucggcaacaucaccuccaucuggaucucccacuccauccagaucggcaaccgcaaccagaucgaggccugcaaccaguccgucaucaccuacgagaacaacaccugggucaaccagaccuacgucaacaucuccaacaccaacuucgccgucggccaguccgucguccccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccguccccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccaacaccgucgacugguccuggcccgacggcgccgagcuccccuucaccaucgacaaguga

SEQ ID NO: 117332 - RNA, 1410 nt, Artificial Sequence
  derived and/or modified sequence opt2 from neuraminidase__InfluenzaA__AIW60703
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccaguacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaagaacugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 117333 - RNA, 1410 nt, Artificial Sequence
  derived and/or modified sequence opt2 from neuraminidase__InfluenzaA__AIW60704
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaucguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccaguacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaagaacugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 117334 - RNA, 1410 nt, Artificial Sequence
  derived and/or modified sequence opt2 from neuraminidase__InfluenzaA__AIW60705
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 117335 - RNA, 1410 nt, Artificial Sequence; identical to SEQ ID NO: 117334
  derived and/or modified sequence opt2 from neuraminidase__InfluenzaA__AIW60706

SEQ ID NO: 117336 - RNA, 1410 nt, Artificial Sequence
  derived and/or modified sequence opt2 from neuraminidase__InfluenzaA__AIW60708
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaacuccuccggcuacuccggcaucuucuccgucgagggcaaguccugcaucaaccgcugcuucuacgucgagcucauccgcggccgcaagcaggagaccgaggucugguggaccuccaacuccaucgucguccucugcggcaccuccggcaccuacggcaccggcuccuggcccgacggcgccgacaucaaccucaugcccaucuga

SEQ ID NO: 117337 - RNA, 1410 nt, Artificial Sequence
  derived and/or modified sequence opt2 from neuraminidase__InfluenzaA__AIW60710
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaccgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117338 - RNA, 1410 nt, Artificial Sequence; identical to SEQ ID NO: 106103
  derived and/or modified sequence opt2 from neuraminidase__InfluenzaA__AIW60711

SEQ ID NO: 117339 - RNA, 1410 nt, Artificial Sequence; identical to SEQ ID NO: 106103
  derived and/or modified sequence opt2 from neuraminidase__InfluenzaA__AIW60712

SEQ ID NO: 117340 - RNA, 1410 nt, Artificial Sequence
  derived and/or modified sequence opt2 from neuraminidase__InfluenzaA__AIW60713
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117341 - RNA, 1410 nt, Artificial Sequence
  derived and/or modified sequence opt2 from neuraminidase__InfluenzaA__AIW60714
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucggccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117342 - RNA, 1410 nt, Artificial Sequence
  derived and/or modified sequence opt2 from neuraminidase__InfluenzaA__AIW60715
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117343 - RNA, 1410 nt, Artificial Sequence; identical to SEQ ID NO: 108023
  derived and/or modified sequence opt2 from neuraminidase__InfluenzaA__AIW60716

SEQ ID NO: 117344 - RNA, 1410 nt, Artificial Sequence
  derived and/or modified sequence opt2 from neuraminidase__InfluenzaA__AIY54970
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgaccucuggaugggccgcaccaucucccagaaccuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117345 - RNA, 1410 nt, Artificial Sequence
  derived and/or modified sequence opt2 from neuraminidase__InfluenzaA__AIY54974
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucauguccgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaaggucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgacaucaaccucaugcccaucuga

SEQ ID NO: 117346 - RNA, 1410 nt, Artificial Sequence
  derived and/or modified sequence opt2 from neuraminidase__InfluenzaA__AIY54982
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117347 - RNA, 1410 nt, Artificial Sequence
  derived and/or modified sequence opt2 from neuraminidase__InfluenzaA__AIY54990
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117348 - RNA, 1401 nt, Artificial Sequence
  derived and/or modified sequence opt2 from neuraminidase__InfluenzaA__AJD78177
augaaccccaaccagaagaucaucgccaucggcuccgucucccucaucaucgccgucaucugccuccucaugcagaucgccauccucaccaccaccaugacccuccacuucaugcagaacgagugcuccaaccccuccaacaaccaggucaugcccugcgagcccaucaucaucgagcgcaacaccguccaccucaacaacaccaccaucgagcgcgagaucugccccaaggccgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 117349 - RNA, 1401 nt, Artificial Sequence
  derived and/or modified sequence opt2 from neuraminidase__InfluenzaA__AJD78189
augaaccccaaccagaagaucaucgccaucggcuccgucucccucaucaucgccaucaucugccuccucaugcagaucgccauccucaccaccaccaugacccuccacuuccgccagaacgagugcaacaacuccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccucccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacaacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugcaaggaccccaacuccgagcgcggcgcccccggcgucaagggcugggccuucgacgacggcaacgacgucuggaugggccgcaccaucaagaacggcucccgcuccggcuacgagaccuuccgcguccucaacggcuggaccgucgccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 117350 - RNA, 1401 nt, Artificial Sequence
  derived and/or modified sequence opt2 from neuraminidase__InfluenzaA__AJD78201
augaaccccaaccagaagaucaccgccaucggcuccgucucccucaucaucgccaucaucugccuccucaugcagaucgccauccucaccaccaccaugacccuccacuuccgccagaaggagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccucaucaccggcuucgcccccuucuccaaggacaacuccauccgccucuccgccggcggcgacaucugggucacccgcgagcccuacgucuccugcucccccgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcguccucuucauccgcgagggcaagaucaucaacauccgcccccucuccggcuccgcccagcacgucgaggagugcuccugcuacccccgcuaccccgagguccgcugcgucugccgcgacaacuggaagggcuccaaccgccccaucaucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucaucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 117351 - RNA, 1401 nt, Artificial Sequence
  derived and/or modified sequence opt2 from neuraminidase__InfluenzaA__AJD78213
augaaccccaaccagaagaucaccgccaucggcuccgucucccucaucaucgccaucaucugccucuucaugcagaucgccauccucaccaccaccaugacccuccacuuccgccagaaggagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccucaucaccggcuucgcccccuucuccaaggacaacuccauccgccucuccgccggcggcgacaucugggucacccgcgagcccuacgucuccugcucccccgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcgucgccgacacccgcguccucuucauccgcgagggcaagaucaucaacauccgcccccucuccggcuccgcccagcacgucgaggagugcuccugcuacccccgcuaccccgagguccgcugcgucugccgcgacaacuggaagggcuccaaccgccccaucaucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucaucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 117352 - RNA, 1410 nt, Artificial Sequence; identical to SEQ ID NO: 114434
  derived and/or modified sequence opt2 from neuraminidase__InfluenzaA__AJI80140

SEQ ID NO: 117353 - RNA, 1410 nt, Artificial Sequence; identical to SEQ ID NO: 114434
  derived and/or modified sequence opt2 from neuraminidase__InfluenzaA__AJI80152

SEQ ID NO: 117354 - RNA, 1410 nt, Artificial Sequence; identical to SEQ ID NO: 117210
  derived and/or modified sequence opt2 from neuraminidase__InfluenzaA__AJI80164

SEQ ID NO: 117355 - RNA, 1410 nt, Artificial Sequence; identical to SEQ ID NO: 117149
  derived and/or modified sequence opt2 from neuraminidase__InfluenzaA__AJI80175

SEQ ID NO: 117356 - RNA, 1410 nt, Artificial Sequence; identical to SEQ ID NO: 117149
  derived and/or modified sequence opt2 from neuraminidase__InfluenzaA__AJI80187

SEQ ID NO: 117357 - RNA, 1410 nt, Artificial Sequence; identical to SEQ ID NO: 117149
  derived and/or modified sequence opt2 from neuraminidase__InfluenzaA__AJI80199

SEQ ID NO: 117358 - RNA, 1410 nt, Artificial Sequence; identical to SEQ ID NO: 117149
  derived and/or modified sequence opt2 from neuraminidase__InfluenzaA__AJI80211

SEQ ID NO: 117359 - RNA, 1410 nt, Artificial Sequence; identical to SEQ ID NO: 115383
  derived and/or modified sequence opt2 from neuraminidase__InfluenzaA__AJI80223

SEQ ID NO: 117360 - RNA, 1410 nt, Artificial Sequence; identical to SEQ ID NO: 117149
  derived and/or modified sequence opt2 from neuraminidase__InfluenzaA__AJI80235

SEQ ID NO: 117361 - RNA, 1410 nt, Artificial Sequence; identical to SEQ ID NO: 115383
  derived and/or modified sequence opt2 from neuraminidase__InfluenzaA__AJI80247

SEQ ID NO: 117362 - RNA, 1410 nt, Artificial Sequence; identical to SEQ ID NO: 117168
  derived and/or modified sequence opt2 from neuraminidase__InfluenzaA__AJI80259

SEQ ID NO: 117363 - RNA, 1410 nt, Artificial Sequence; identical to SEQ ID NO: 113658
  derived and/or modified sequence opt2 from neuraminidase__InfluenzaA__AJI80271

SEQ ID NO: 117364 - RNA, 1410 nt, Artificial Sequence; identical to SEQ ID NO: 117149
  derived and/or modified sequence opt2 from neuraminidase__InfluenzaA__AJI80283

SEQ ID NO: 117365 - RNA, 1410 nt, Artificial Sequence
  derived and/or modified sequence opt2 from neuraminidase__InfluenzaA__AJI80306
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccucgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117366 - RNA, 1410 nt, Artificial Sequence
  derived and/or modified sequence opt2 from neuraminidase__InfluenzaA__AJI80318
augaaccccaaccagaagaucaucaccaucggcuccgucugcaugaccaucggcauggccaaccucauccuccagaucggcaacaucaucuccaucuggaucucccacuccauccagcucggcaaccagucccagaucgaggccugcaaccagaacgucaucaccuacgagaacaacaccugggucaaccagaccuacgucaacaucuccaacaccaacuucgccaccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117367 - RNA, 1410 nt, Artificial Sequence
  derived and/or modified sequence opt2 from neuraminidase__InfluenzaA__AJI80329
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117368 - RNA, 1410 nt, Artificial Sequence
  derived and/or modified sequence opt2 from neuraminidase__InfluenzaA__AJI80340
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggaagaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117369 - RNA, 1410 nt, Artificial Sequence; identical to SEQ ID NO: 113658
  derived and/or modified sequence opt2 from neuraminidase__InfluenzaA__AJI80351

SEQ ID NO: 117370 - RNA, 1410 nt, Artificial Sequence
  derived and/or modified sequence opt2 from neuraminidase__InfluenzaA__AJI80363
augaaccccaaccagaagaucaucaccaucggcuccgucucccucaccaucuccaccaucugcuucuucaugcagaucgccauccucaucaccaccgucacccuccacuucaagcaguacgaguucaacucccuccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcggcgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117371 - RNA, 1410 nt, Artificial Sequence
  derived and/or modified sequence opt2 from neuraminidase__InfluenzaA__AJI80375
augaaccccaaccagaagaucaucaccaucggcuccgucucccucaccaucuccaccaucugccucuucaugcagaucgccauccucaucaccaccgucacccuccacuucaagcagcacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117372 - RNA, 1410 nt, Artificial Sequence; identical to SEQ ID NO: 117188
  derived and/or modified sequence opt2 from neuraminidase__InfluenzaA__AJI80387

SEQ ID NO: 117373 - RNA, 1410 nt, Artificial Sequence; identical to SEQ ID NO: 117188
  derived and/or modified sequence opt2 from neuraminidase__InfluenzaA__AJI80398

SEQ ID NO: 117374 - RNA, 1410 nt, Artificial Sequence; identical to SEQ ID NO: 117188
  derived and/or modified sequence opt2 from neuraminidase__InfluenzaA__AJI80409

SEQ ID NO: 117375 - RNA, 1410 nt, Artificial Sequence; identical to SEQ ID NO: 117188
  derived and/or modified sequence opt2 from neuraminidase__InfluenzaA__AJI80420

SEQ ID NO: 117376 - RNA, 1410 nt, Artificial Sequence; identical to SEQ ID NO: 117188
  derived and/or modified sequence opt2 from neuraminidase__InfluenzaA__AJI80431

SEQ ID NO: 117377 - RNA, 1410 nt, Artificial Sequence; identical to SEQ ID NO: 117183
  derived and/or modified sequence opt2 from neuraminidase__InfluenzaA__AJI80442

SEQ ID NO: 117378 - RNA, 1410 nt, Artificial Sequence; identical to SEQ ID NO: 117188
  derived and/or modified sequence opt2 from neuraminidase__InfluenzaA__AJI80454

SEQ ID NO: 117379 - RNA, 1410 nt, Artificial Sequence; identical to SEQ ID NO: 117183
  derived and/or modified sequence opt2 from neuraminidase__InfluenzaA__AJI80465

SEQ ID NO: 117380 - RNA, 1410 nt, Artificial Sequence; identical to SEQ ID NO: 117188
  derived and/or modified sequence opt2 from neuraminidase__InfluenzaA__AJI80477

SEQ ID NO: 117381 - RNA, 1410 nt, Artificial Sequence; identical to SEQ ID NO: 117188
  derived and/or modified sequence opt2 from neuraminidase__InfluenzaA__AJI80488

SEQ ID NO: 117382 - RNA, 1410 nt, Artificial Sequence; identical to SEQ ID NO: 117210
  derived and/or modified sequence opt2 from neuraminidase__InfluenzaA__AJI80499

SEQ ID NO: 117383 - RNA, 1410 nt, Artificial Sequence; identical to SEQ ID NO: 117188
  derived and/or modified sequence opt2 from neuraminidase__InfluenzaA__AJI80510

SEQ ID NO: 117384 - RNA, 1410 nt, Artificial Sequence; identical to SEQ ID NO: 117210
  derived and/or modified sequence opt2 from neuraminidase__InfluenzaA__AJI80521

SEQ ID NO: 117385 - RNA, 1410 nt, Artificial Sequence
  derived and/or modified sequence opt2 from neuraminidase__InfluenzaA__AJJ98767
augaaccccaaccagaagaucaucaccaucggcuccgucucccucaccaucuccaccaucugcuucuucaugcagaucgccauccucaucaccaccgucacccuccacuucaagcaguacgaguucaacucccccuccaacaaccaggucaugcucugcgagcccaccaucaucgagcgcaacaucaccgagaucgucuaccucaccaacaccaccaucgagaaggagaagugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcgacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 117386 - RNA, 1410 nt, Artificial Sequence
  derived and/or modified sequence opt2 from neuraminidase__InfluenzaA__AJJ98779
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccuggaccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117387 - RNA, 1410 nt, Artificial Sequence; identical to SEQ ID NO: 113658
  derived and/or modified sequence opt2 from neuraminidase__InfluenzaA__AJJ98791

SEQ ID NO: 117388 - RNA, 1410 nt, Artificial Sequence
  derived and/or modified sequence opt2 from neuraminidase__InfluenzaA__AJJ98803
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaagguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117389 - RNA, 1410 nt, Artificial Sequence; identical to SEQ ID NO: 113658
  derived and/or modified sequence opt2 from neuraminidase__InfluenzaA__AJJ98815

SEQ ID NO: 117390 - RNA, 1410 nt, Artificial Sequence
  derived and/or modified sequence opt2 from neuraminidase__InfluenzaA__AJJ98827
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacaacaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117391 - RNA, 1410 nt, Artificial Sequence; identical to SEQ ID NO: 112655
  derived and/or modified sequence opt2 from neuraminidase__InfluenzaA__AJJ98839

SEQ ID NO: 117392 - RNA, 1410 nt, Artificial Sequence; identical to SEQ ID NO: 111030
  derived and/or modified sequence opt2 from neuraminidase__InfluenzaA__AJJ98851

SEQ ID NO: 117393 - RNA, 1410 nt, Artificial Sequence
  derived and/or modified sequence opt2 from neuraminidase__InfluenzaA__AJJ98863
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgagcgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcaucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117394 - RNA, 1410 nt, Artificial Sequence
  derived and/or modified sequence opt2 from neuraminidase__InfluenzaA__AJJ98875
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117395 - RNA, 1410 nt, Artificial Sequence
  derived and/or modified sequence opt2 from neuraminidase__InfluenzaA__AJJ98887
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 117396 - RNA, 1410 nt, Artificial Sequence
  derived and/or modified sequence opt2 from neuraminidase__InfluenzaA__AJJ98899
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117397 - RNA, 1410 nt, Artificial Sequence; identical to SEQ ID NO: 113658
  derived and/or modified sequence opt2 from neuraminidase__InfluenzaA__AJJ98911

SEQ ID NO: 117398 - RNA, 1410 nt, Artificial Sequence; identical to SEQ ID NO: 114434
  derived and/or modified sequence opt2 from neuraminidase__InfluenzaA__AJJ98923

SEQ ID NO: 117399 - RNA, 1410 nt, Artificial Sequence
  derived and/or modified sequence opt2 from neuraminidase__InfluenzaA__AJJ98935
augaaccccaaccagaagaucaucaccaucggcuccgucucccucaccaucuccaccaucugcuucuucaugcagaucgccauccucaucaccaccgucacccuccacuucaagcgcuacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117400 - RNA, 1410 nt, Artificial Sequence
  derived and/or modified sequence opt2 from neuraminidase__InfluenzaA__AJJ98947
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucacccucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcaacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117401 - RNA, 1410 nt, Artificial Sequence
  derived and/or modified sequence opt2 from neuraminidase__InfluenzaA__AJJ98971
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117402 - RNA, 1410 nt, Artificial Sequence
  derived and/or modified sequence opt2 from neuraminidase__InfluenzaA__AJJ98995
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117403 - RNA, 1410 nt, Artificial Sequence; identical to SEQ ID NO: 112655
  derived and/or modified sequence opt2 from neuraminidase__InfluenzaA__AJJ99007

SEQ ID NO: 117404 - RNA, 1410 nt, Artificial Sequence
  derived and/or modified sequence opt2 from neuraminidase__InfluenzaA__AJJ99019
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccaacuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117405 - RNA, 1410 nt, Artificial Sequence
  derived and/or modified sequence opt2 from neuraminidase__InfluenzaA__AJJ99031
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccaccaucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117406 - RNA, 1410 nt, Artificial Sequence
  derived and/or modified sequence opt2 from neuraminidase__InfluenzaA__AJJ99043
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaugaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117407 - RNA, 1410 nt, Artificial Sequence
  derived and/or modified sequence opt2 from neuraminidase__InfluenzaA__AJJ99067
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117408 - RNA, 1410 nt, Artificial Sequence
  derived and/or modified sequence opt2 from neuraminidase__InfluenzaA__AJJ99079
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117409 - RNA, 1410 nt, Artificial Sequence
  derived and/or modified sequence opt2 from neuraminidase__InfluenzaA__AJJ99091
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgaccucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117410 - RNA, 1410 nt, Artificial Sequence
  derived and/or modified sequence opt2 from neuraminidase__InfluenzaA__AJJ99103
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117411 - RNA, 1410 nt, Artificial Sequence; identical to SEQ ID NO: 116877
  derived and/or modified sequence opt2 from neuraminidase__InfluenzaA__AJJ99115

SEQ ID NO: 117412 - RNA, 1410 nt, Artificial Sequence; identical to SEQ ID NO: 115797
  derived and/or modified sequence opt2 from neuraminidase__InfluenzaA__AJJ99127

SEQ ID NO: 117413 - RNA, 1410 nt, Artificial Sequence; identical to SEQ ID NO: 117085
  derived and/or modified sequence opt2 from neuraminidase__InfluenzaA__AJJ99139

SEQ ID NO: 117414 - RNA, 1410 nt, Artificial Sequence
  derived and/or modified sequence opt2 from neuraminidase__InfluenzaA__AJJ99151
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117415 - RNA, 1410 nt, Artificial Sequence; identical to SEQ ID NO: 108111
  derived and/or modified sequence opt2 from neuraminidase__InfluenzaA__AJJ99163

SEQ ID NO: 117416 - RNA, 1410 nt, Artificial Sequence
  derived and/or modified sequence opt2 from neuraminidase__InfluenzaA__AJJ99175
augaaccccaaccagaagaucaucaccaucggcuccgucucccucaccaucuccaccaucugccucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcaccgacaucaaccucaugcccaucuga

SEQ ID NO: 117417 - RNA, 1410 nt, Artificial Sequence
  derived and/or modified sequence opt2 from neuraminidase__InfluenzaA__AJJ99199
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117418 - RNA, 1410 nt, Artificial Sequence; identical to SEQ ID NO: 108255
  derived and/or modified sequence opt2 from neuraminidase__InfluenzaA__AJJ99211

SEQ ID NO: 117419 - RNA, 1410 nt, Artificial Sequence
  derived and/or modified sequence opt2 from neuraminidase__InfluenzaA__AJJ99223
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucugggucggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117420 - RNA, 1410 nt, Artificial Sequence
  derived and/or modified sequence opt2 from neuraminidase__InfluenzaA__AJJ99235
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117421 - RNA, 1410 nt, Artificial Sequence
  derived and/or modified sequence opt2 from neuraminidase__InfluenzaA__AJJ99246
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccagaacgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugccucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccuccggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117422 - RNA, 1410 nt, Artificial Sequence
  derived and/or modified sequence opt2 from neuraminidase__InfluenzaA__AJJ99257
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccguccccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 117423 - RNA, 1413 nt, Artificial Sequence; identical to SEQ ID NO: 108144
  derived and/or modified sequence opt2 from neuraminidase__InfluenzaA__AJJ99269

SEQ ID NO: 117424 - RNA, 1410 nt, Artificial Sequence; identical to SEQ ID NO: 112470
  derived and/or modified sequence opt2 from neuraminidase__InfluenzaA__AJJ99280

SEQ ID NO: 117425 - RNA, 1410 nt, Artificial Sequence; identical to SEQ ID NO: 112221
  derived and/or modified sequence opt2 from neuraminidase__InfluenzaA__AJJ99291

SEQ ID NO: 117426 - RNA, 1413 nt, Artificial Sequence
  derived and/or modified sequence opt2 from neuraminidase__InfluenzaA__AJJ99303
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccauggagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117427 - RNA, 1410 nt, Artificial Sequence
  derived and/or modified sequence opt2 from neuraminidase__InfluenzaA__AJJ99314
augaaccccaaccagaagaucaucaccaucggcuccgccugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117428 - RNA, 1413 nt, Artificial Sequence
  derived and/or modified sequence opt2 from neuraminidase__InfluenzaA__AJJ99326
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggccucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117429 - RNA, 1410 nt, Artificial Sequence; identical to SEQ ID NO: 109894
  derived and/or modified sequence opt2 from neuraminidase__InfluenzaA__AJJ99337

SEQ ID NO: 117430 - RNA, 1410 nt, Artificial Sequence; identical to SEQ ID NO: 109357
  derived and/or modified sequence opt2 from neuraminidase__InfluenzaA__AJJ99348

SEQ ID NO: 117431 - RNA, 1410 nt, Artificial Sequence; identical to SEQ ID NO: 108250
  derived and/or modified sequence opt2 from neuraminidase__InfluenzaA__AJJ99359

SEQ ID NO: 117432 - RNA, 1410 nt, Artificial Sequence
  derived and/or modified sequence opt2 from neuraminidase__InfluenzaA__AJJ99370
augaaccccaaccagaagaucaucaccaucggcuccgucugcaugaucaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgaccgccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117433 - RNA, 1410 nt, Artificial Sequence; identical to SEQ ID NO: 111769
  derived and/or modified sequence opt2 from neuraminidase__InfluenzaA__AJJ99381

SEQ ID NO: 117434 - RNA, 1410 nt, Artificial Sequence
  derived and/or modified sequence opt2 from neuraminidase__InfluenzaA__AJJ99392
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucucccccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccaagcuccccuucaccaucgacaaguga

SEQ ID NO: 117435 - RNA, 1410 nt, Artificial Sequence; identical to SEQ ID NO: 108250
  derived and/or modified sequence opt2 from neuraminidase__InfluenzaA__AJJ99403

SEQ ID NO: 117436 - RNA, 1413 nt, Artificial Sequence; identical to SEQ ID NO: 108973
  derived and/or modified sequence opt2 from neuraminidase__InfluenzaA__AJJ99415

SEQ ID NO: 117437 - RNA, 1413 nt, Artificial Sequence
  derived and/or modified sequence opt2 from neuraminidase__InfluenzaA__AJJ99427
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccgucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccgacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaucaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117438 - RNA, 1413 nt, Artificial Sequence
  derived and/or modified sequence opt2 from neuraminidase__InfluenzaA__AJJ99439
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaccuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117439 - RNA, 1413 nt, Artificial Sequence
  derived and/or modified sequence opt2 from neuraminidase__InfluenzaA__AJJ99451
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaaccgcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117440 - RNA, 1413 nt, Artificial Sequence; identical to SEQ ID NO: 108144
  derived and/or modified sequence opt2 from neuraminidase__InfluenzaA__AJJ99463

SEQ ID NO: 117441 - RNA, 1410 nt, Artificial Sequence
  derived and/or modified sequence opt2 from neuraminidase__InfluenzaA__AJJ99474
augaaccccaaccagaagaucaucaccaucggcuccgucugcaugaccaucggcaucgccaaccucauccuccagaucggcaacaucaucuccaucuggaucucccacuccauccagcucggcaaccagaaccagaucgagaccugcaaccaguccgucaucaucuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 117442 - RNA, 1410 nt, Artificial Sequence; identical to SEQ ID NO: 112221
  derived and/or modified sequence opt2 from neuraminidase__InfluenzaA__AJJ99496

SEQ ID NO: 117443 - RNA, 1410 nt, Artificial Sequence
  derived and/or modified sequence opt2 from neuraminidase__InfluenzaA__AJJ99507
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcgccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacgacaacggcgucuggaucggccgcaccaaguccaucuccucccgcaacggcuucgagaugaucugggaccccaacggcuggaccggcaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117444 - RNA, 1410 nt, Artificial Sequence; identical to SEQ ID NO: 108250
  derived and/or modified sequence opt2 from neuraminidase__InfluenzaA__AJJ99518

SEQ ID NO: 117445 - RNA, 1410 nt, Artificial Sequence
  derived and/or modified sequence opt2 from neuraminidase__InfluenzaA__AJJ99529
augaaccccaaccagaagaucaucaccaucggcuccgucugcaugaccaucggcauggccaaccucauccuccaggucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcuucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 117446 - RNA, 1410 nt, Artificial Sequence
  derived and/or modified sequence opt2 from neuraminidase__InfluenzaA__AJJ99540
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccaagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcaucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117447 - RNA, 1410 nt, Artificial Sequence
  derived and/or modified sequence opt2 from neuraminidase__InfluenzaA__AJJ99551
augaaccccaaccagaagaucaucaccaucggcuccgucugcaugaccaucggcauggccaaccucauccuccagaucggcaacaucaucuccaucuggaucucccacuccauccagcucggcaaccagucccagaccgagaccugcaaccaguccgucaucaccuacgagaacaacaccugggucaaccagaccuacgucaacaucuccaacaccaaccccgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccucccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117448 - RNA, 1410 nt, Artificial Sequence; identical to SEQ ID NO: 112237
  derived and/or modified sequence opt2 from neuraminidase__InfluenzaA__AJJ99562

SEQ ID NO: 117449 - RNA, 1410 nt, Artificial Sequence
  derived and/or modified sequence opt2 from neuraminidase__InfluenzaA__AJJ99573
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacgucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117450 - RNA, 1410 nt, Artificial Sequence; identical to SEQ ID NO: 117427
  derived and/or modified sequence opt2 from neuraminidase__InfluenzaA__AJJ99584

SEQ ID NO: 117451 - RNA, 1410 nt, Artificial Sequence
  derived and/or modified sequence opt2 from neuraminidase__InfluenzaA__AJJ99595
augaaccccaaccagaagaucaucaccaucggcuccgucugcaugaccaucggcauggccaaccucaucuuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117452 - RNA, 1410 nt, Artificial Sequence
  derived and/or modified sequence opt2 from neuraminidase__InfluenzaA__AJJ99606
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcgucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117453 - RNA, 1413 nt, Artificial Sequence; identical to SEQ ID NO: 108973
  derived and/or modified sequence opt2 from neuraminidase__InfluenzaA__AJJ99618

SEQ ID NO: 117454 - RNA, 1413 nt, Artificial Sequence
  derived and/or modified sequence opt2 from neuraminidase__InfluenzaA__AJJ99630
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccaugaagcagaacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117455 - RNA, 1413 nt, Artificial Sequence; identical to SEQ ID NO: 108973
  derived and/or modified sequence opt2 from neuraminidase__InfluenzaA__AJJ99642

SEQ ID NO: 117456 - RNA, 1413 nt, Artificial Sequence; identical to SEQ ID NO: 108973
  derived and/or modified sequence opt2 from neuraminidase__InfluenzaA__AJJ99654

SEQ ID NO: 117457 - RNA, 1413 nt, Artificial Sequence
  derived and/or modified sequence opt2 from neuraminidase__InfluenzaA__AJJ99666
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaacaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117458 - RNA, 1410 nt, Artificial Sequence
  derived and/or modified sequence opt2 from neuraminidase__InfluenzaA__AJJ99677
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaugaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 117459 - RNA, 1410 nt, Artificial Sequence
  derived and/or modified sequence opt2 from neuraminidase__InfluenzaA__AJJ99688
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 117460 - RNA, 1410 nt, Artificial Sequence
  derived and/or modified sequence opt2 from neuraminidase__InfluenzaA__AJJ99710
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccaagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117461 - RNA, 1410 nt, Artificial Sequence; identical to SEQ ID NO: 111769
  derived and/or modified sequence opt2 from neuraminidase__InfluenzaA__AJJ99721

SEQ ID NO: 117462 - RNA, 1410 nt, Artificial Sequence; identical to SEQ ID NO: 111769
  derived and/or modified sequence opt2 from neuraminidase__InfluenzaA__AJJ99732

SEQ ID NO: 117463 - RNA, 1410 nt, Artificial Sequence; identical to SEQ ID NO: 112469
  derived and/or modified sequence opt2 from neuraminidase__InfluenzaA__AJJ99743

SEQ ID NO: 117464 - RNA, 1410 nt, Artificial Sequence; identical to SEQ ID NO: 109803
  derived and/or modified sequence opt2 from neuraminidase__InfluenzaA__AJJ99754

SEQ ID NO: 117465 - RNA, 1410 nt, Artificial Sequence
  derived and/or modified sequence opt2 from neuraminidase__InfluenzaA__AJJ99765
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccaccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117466 - RNA, 1413 nt, Artificial Sequence
  derived and/or modified sequence opt2 from neuraminidase__InfluenzaA__AJJ99777
augaaccccaaccagaagaucaucaccaucggcuccaucuccaucgccaucggcaucaucucccucauccuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccgccgucuggaccuccggcuccuccaucuccuucugcggcgucaacuccgacaccgccaacugguccuggcccgacggcgccgagcuccccuucaccaucgacaaguga

SEQ ID NO: 117467 - RNA, 1410 nt, Artificial Sequence; identical to SEQ ID NO: 108250
  derived and/or modified sequence opt2 from neuraminidase__InfluenzaA__AJJ99788

SEQ ID NO: 117468 - RNA, 1413 nt, Artificial Sequence
  derived and/or modified sequence opt2 from neuraminidase__InfluenzaA__AJJ99800
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaucaucgacaaguga

SEQ ID NO: 117469 - RNA, 1413 nt, Artificial Sequence; identical to SEQ ID NO: 108973
  derived and/or modified sequence opt2 from neuraminidase__InfluenzaA__AJJ99812

SEQ ID NO: 117470 - RNA, 1413 nt, Artificial Sequence
  derived and/or modified sequence opt2 from neuraminidase__InfluenzaA__AJJ99824
augaaccccaaccagaagaucaucaccaucggcuccaucuccaucgccaucggcaccaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117471 - RNA, 1410 nt, Artificial Sequence; identical to SEQ ID NO: 117459
  derived and/or modified sequence opt2 from neuraminidase__InfluenzaA__AJJ99835

SEQ ID NO: 117472 - RNA, 1410 nt, Artificial Sequence; identical to SEQ ID NO: 111769
  derived and/or modified sequence opt2 from neuraminidase__InfluenzaA__AJJ99846

SEQ ID NO: 117473 - RNA, 1410 nt, Artificial Sequence; identical to SEQ ID NO: 111769
  derived and/or modified sequence opt2 from neuraminidase__InfluenzaA__AJJ99857

SEQ ID NO: 117474 - RNA, 1410 nt, Artificial Sequence
  derived and/or modified sequence opt2 from neuraminidase__InfluenzaA__AJJ99868
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgucaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcagaacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117475 - RNA, 1410 nt, Artificial Sequence; identical to SEQ ID NO: 110669
  derived and/or modified sequence opt2 from neuraminidase__InfluenzaA__AJJ99879

SEQ ID NO: 117476 - RNA, 1410 nt, Artificial Sequence; identical to SEQ ID NO: 108250
  derived and/or modified sequence opt2 from neuraminidase__InfluenzaA__AJJ99890

SEQ ID NO: 117477 - RNA, 1410 nt, Artificial Sequence
  derived and/or modified sequence opt2 from neuraminidase__InfluenzaA__AJJ99901
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucgacuccggcaccgucggcugguccuggcccgacggcgccgagcuccccuucaccaucgacaaguga

SEQ ID NO: 117478 - RNA, 1410 nt, Artificial Sequence
  derived and/or modified sequence opt2 from neuraminidase__InfluenzaA__AJJ99912
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccaagaucaccugcgucugccgcgacaacuggcacggcuccaaccgccccugggucuccuucaaccagaaccucgaguaccagaucggcuacaucugcuccggcaucuucggcgacaacccccgccccaaggacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117479 - RNA, 1410 nt, Artificial Sequence; identical to SEQ ID NO: 111769
  derived and/or modified sequence opt2 from neuraminidase__InfluenzaA__AJJ99923

SEQ ID NO: 117480 - RNA, 1410 nt, Artificial Sequence; identical to SEQ ID NO: 112221
  derived and/or modified sequence opt2 from neuraminidase__InfluenzaA__AJJ99934

SEQ ID NO: 117481 - RNA, 1410 nt, Artificial Sequence; identical to SEQ ID NO: 111769
  derived and/or modified sequence opt2 from neuraminidase__InfluenzaA__AJJ99945

SEQ ID NO: 117482 - RNA, 1410 nt, Artificial Sequence
  derived and/or modified sequence opt2 from neuraminidase__InfluenzaA__AJJ99956
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccguccucuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117483 - RNA, 1410 nt, Artificial Sequence; identical to SEQ ID NO: 108250
  derived and/or modified sequence opt2 from neuraminidase__InfluenzaA__AJJ99967

SEQ ID NO: 117484 - RNA, 1413 nt, Artificial Sequence
  derived and/or modified sequence opt2 from neuraminidase__InfluenzaA__AJJ99991
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacugcaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117485 - RNA, 1410 nt, Artificial Sequence; identical to SEQ ID NO: 117459
  derived and/or modified sequence opt2 from neuraminidase__InfluenzaA__AJK00003

SEQ ID NO: 117486 - RNA, 1410 nt, Artificial Sequence
  derived and/or modified sequence opt2 from neuraminidase__InfluenzaA__AJK00014
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcgucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaccaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaacuga

SEQ ID NO: 117487 - RNA, 1410 nt, Artificial Sequence
  derived and/or modified sequence opt2 from neuraminidase__InfluenzaA__AJK00025
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 117488 - RNA, 1410 nt, Artificial Sequence
  derived and/or modified sequence opt2 from neuraminidase__InfluenzaA__AJK00036
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaucaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117489 - RNA, 1410 nt, Artificial Sequence; identical to SEQ ID NO: 112469
  derived and/or modified sequence opt2 from neuraminidase__InfluenzaA__AJK00047

SEQ ID NO: 117490 - RNA, 1410 nt, Artificial Sequence; identical to SEQ ID NO: 112469
  derived and/or modified sequence opt2 from neuraminidase__InfluenzaA__AJK00058

SEQ ID NO: 117491 - RNA, 1410 nt, Artificial Sequence
  derived and/or modified sequence opt2 from neuraminidase__InfluenzaA__AJK00069
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacuucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117492 - RNA, 1413 nt, Artificial Sequence; identical to SEQ ID NO: 108973
  derived and/or modified sequence opt2 from neuraminidase__InfluenzaA__AJK00081

SEQ ID NO: 117493 - RNA, 1413 nt, Artificial Sequence; identical to SEQ ID NO: 108144
  derived and/or modified sequence opt2 from neuraminidase__InfluenzaA__AJK00093

SEQ ID NO: 117494 - RNA, 1413 nt, Artificial Sequence
  derived and/or modified sequence opt2 from neuraminidase__InfluenzaA__AJK00105
augucccccaaccagaagaucaucaccaucggcuccaucuccaucgccaucggcaucaucucccucaugcuccagaucggcaacaccaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117495 - RNA, 1410 nt, Artificial Sequence; identical to SEQ ID NO: 110525
  derived and/or modified sequence opt2 from neuraminidase__InfluenzaA__AJK00116

SEQ ID NO: 117496 - RNA, 1410 nt, Artificial Sequence; identical to SEQ ID NO: 109357
  derived and/or modified sequence opt2 from neuraminidase__InfluenzaA__AJK00127

SEQ ID NO: 117497 - RNA, 1410 nt, Artificial Sequence; identical to SEQ ID NO: 108250
  derived and/or modified sequence opt2 from neuraminidase__InfluenzaA__AJK00138

SEQ ID NO: 117498 - RNA, 1350 nt, Artificial Sequence
  derived and/or modified sequence opt2 from neuraminidase__InfluenzaA__AJK00152
augaaccccaaccagaagaucaucaccaucggcuccaucugcauggucaccggcaucgucucccucaugcuccagaucggcaacaucaucuccaugugggucucccacuccauccagacccgcaaccagcaccagaccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccucaucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgagaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117499 - RNA, 1350 nt, Artificial Sequence
  derived and/or modified sequence opt2 from neuraminidase__InfluenzaA__AJK00167
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacgccaacuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccgagaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117500 - RNA, 1350 nt, Artificial Sequence
  derived and/or modified sequence opt2 from neuraminidase__InfluenzaA__AJK00178
augaaccccaaccagaagaucaucaccaucggcuccaucugcauggucaucggcaucgucucccucaugcuccagaucggcaacaugaucuccaucugggccucccacuccauccgcaccggcaaccagaaccaggucgagcccaucaucaacaccaacuuccccaccgagaaggccgccgccuccaucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaagaccuggcgcaacaacauccuccgcacccaggaguccgagugcgccugcgucaacggcuccugcuucaccgucaugaccgacggccccuccgacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaccgacggcaccggcuccugcggccccgucucccacaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucuccugguccuggcccgacggcgccgagcuccccuucaccaucgacaaguga

SEQ ID NO: 117501 - RNA, 1350 nt, Artificial Sequence
  derived and/or modified sequence opt2 from neuraminidase__InfluenzaA__AJK00199
augaaccccaaccagaagaucaucaccaucggcuccaucugcauggucaucggcaucgucucccucaugcuccagaucggcaacaugaucuccaucugggucucccacuccauccagaccggcaaccagaaccaggucgagcccaucaucaacaccaacuuccucaccgagaaggccgucgucuccaucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgccgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcucccccgucucccacaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucuccugguccuggcccgacggcgccgagcuccccuucaccaucgacaaguga

SEQ ID NO: 117502 - RNA, 1350 nt, Artificial Sequence
  derived and/or modified sequence opt2 from neuraminidase__InfluenzaA__AJK00208
augaaccccaaccagaagaucaucaccaucggcuccaucugcauggucaccggcaucgucucccucaugcuccagaucggcaacaucaucuccaugugggucucccacuccauccagacccgcaaccagcaccagaccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgagaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117503 - RNA, 1350 nt, Artificial Sequence
  derived and/or modified sequence opt2 from neuraminidase__InfluenzaA__AJK00219
augaaccccaaccagaagaucaucaccaucggcuccaucugcauggucaccggcaucgucucccucaugcuccagaucggcaacaucaucuccaugugggucucccacuccauccagacccgcaaccagcaccaggccgagcccauccgcaacaccaacuuccucaccgagaacgccgucgccuccgucacccucgccggcaaccucucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgagaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117504 - RNA, 1350 nt, Artificial Sequence
  derived and/or modified sequence opt2 from neuraminidase__InfluenzaA__AJK00230
augaaccccaaccagaagaucaucaccaucggcuccaucugcauggucaccggcaucgucucccucaugcuccagaucggcaacaucaucuccaugugggucucccacuccauccagacccgcaaccagcaccagaccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccucaucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgagaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117505 - RNA, 1380 nt, Artificial Sequence
  derived and/or modified sequence opt2 from neuraminidase__InfluenzaA__AJS18470
augaaccccaaccagaagaucaccugcaucuccgccaccggcgucacccucuccgucgucucccuccucaucggcaucgccaaccucggccucaacaucggccuccacuacaaggucgacgacuccaccaccaucaacauccccaacaugaacgagaccaaccccaccaucaccaacaucaccaacaucaucgucaacaagaacgaggagcgcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggucggcaacauccuccgcacccaggaguccgagugcgucugccacaagggcaucugccccgucgucaugaccgacggccccgccaacaacaaggccgccaccaagaucaucuacuucaaggagggcaagauccagaagaucgaggagcuccagggcaacgcccagcacgucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgcccccaucaucggcggcucccccgaccccggcgucaagggcuucgccuaccucgacggcgagaacuccuggcucggccgcaccaucuccaaggacucccgcuccggcuacgagaugcucaagguccccaacgccgagaccgacacccaguccggccccaccuccuaccagcucaucgucaacaaccagaacugguccggcuacuccggcgccuucaucgacuacugggccaacaagggcugcuucaaccccugcuucuacgucgagcucauccgcggccgccccaaggagaucgacguccucuggaccuccaacuccauggucgcccucugcggcucccgcgagcgccucggcuccugguccuggcacgacggcgccgagaucaucuacuucaaguga

SEQ ID NO: 117506 - RNA, 1380 nt, Artificial Sequence
  derived and/or modified sequence opt2 from neuraminidase__InfluenzaA__AJS18481
augaaccccaaccagaagaucaccugcaucuccgccaccggcgucacccucuccgucgucucccuccucaucggcaucgccaaccucggccucaacaucggccuccacuacaaggucuccgacuccaccaccaucaacucccccaacaugaacgagaccaaccccaccaccaccaacaucaccaacaucaucgucaacaagaacgaggagcgcaccuuccucaaccucaccaagccccucugcgaggucaacuccuggcacauccucuccaaggacaacgccauccgcaucggcgaggaggcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggccggcaacauccuccgcacccaggaguccgagugcgucugccacaagggcaucugccccgucgucaugaccgacggccccgccaacaacaaggccgccaccaagaucaucuacuuccgcgagggcaagauccagaagaucgaggagcuccagggcaacgcccagcacaucgaggagugcuccugcuacggcgccgccggcaugaucaagugcgccugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgcccccgucaccggcggcucccccgaccccggcaucaagggcuucgccuuccucgacggcgagaacuccuggcucggccgcaccaucuccaagaacucccgcuccggcuacgagaugcucaagguccccaacgccgagaccgacacccaguccggccccaccuccuaccagcucaucgucaacaaccagaacugguccggcuacuccggcgccuucaucgacuacugggccaacaaggagugcuucaaccccugcuucuacgucgagcucauccgcggccgccccaaggaguccgacguccucuggaccuccaacuccauggucgcccucugcggcucccgcgagcgccucggcuccugguccuggcacgacggcgccgagaucaucuacuucaaguga

SEQ ID NO: 117507 - RNA, 1410 nt, Artificial Sequence
  derived and/or modified sequence opt2 from neuraminidase__InfluenzaA__AKA59350
augaaccccaaccagaagaucaucaccaucggcuccgucugcaugaccaucggcgucgccaaccucauccuccagaucggcaacaucaucuccaucuggaucucccacuccauccagcucggcaaccagaaccagaucgagaccugcaaccaguccgucaucaccuacgagaacaacaccugggucaaccagaccgacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 117508 - RNA, 1410 nt, Artificial Sequence
  derived and/or modified sequence opt2 from neuraminidase__InfluenzaA__AKA59352
augaaccccaaccagaagaucaucaccaucggcuccgucugcaugaccaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaaccucgccgucggccaguccgucgucuccaccaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117509 - RNA, 1410 nt, Artificial Sequence
  derived and/or modified sequence opt2 from neuraminidase__InfluenzaA__AKA59354
augaaccccaaccagaagaucaucaccaucggcuccgucugcaugaccaucggcgucgccaaccucauccuccagaucggcaacaucaucuccaucuggaucucccacuccauccagcucggcaaccagaaccagaucgagaccugcaaccaguccgucaucaccuacgagaacaacaccugggccaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 117510 - RNA, 1380 nt, Artificial Sequence
  derived and/or modified sequence opt2 from neuraminidase__InfluenzaA__AKS48026
augaaccccaaccagaagaucaccugcaucuccgccaccggcgucacccucuccgucgucucccuccucaucggcaucgccaaccucggccucaacaucggccuccacuacaaggucuccgacuccaccaccaucaacauccccaacaugaacgagaccaaccccaccaccaccaacaucaccaacaucaucgucaacaagaacgaggagcgcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgacaagucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggucggcaacauccuccgcacccaggaguccgagugcgucugccacaagggcaucugccccgucgucaugaccgacggccccgccaacaacaaggccgccaccaagaucaucuacuucaaggagggcaagauccagaagaucgaggagcuccagggcaacgcccagcacaucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgagcccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccuccuaccagcucaucgucaacaaccagaacugguccggcuacuccggcgccuucaucgacuacugggccaacaaggagugcuucaaccccugcuucuacgucgagcucauccgcggccgccccaaggagaucgacguccucugggccuccaacuccauggucgcccucugcggcucccgcgagcgccucggcuccugguccuggcacgacggcgccgagaucaucuacuucaaguga

SEQ ID NO: 117511 - RNA, 1380 nt, Artificial Sequence
  derived and/or modified sequence opt2 from neuraminidase__InfluenzaA__AKS48040
augaaccccaaccagaagaucaccugcaucuccgccaccggcaugacccucuccgucgucucccuccucaucggcaucgccaaccucggccucaacaucggccuccacuacaaggucuccgacuccaccaccaucaacauccccaacaugaacgagaccaaccccaccaccaccaacaucaccaacaucaucgucaacaagaacgaggagcgcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggucggcaacauccuccgcacccaggaguccgagugcgucugccacaagggcaucugccccgucgucaugaccgacggccccgccaacaacaaggccgccaccaagaucaucuacuucaaggagggcaagauccagaagaucgaggagcuccagggcaacgcccagcacaucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccuccuaccagcucaucgucaacaaccagaacugguccggcuacuccggcgccuucaucgacuacugggccaacaaggagugcuucaaccccugcuucuacgucgagcucauccgcggccgccccaaggagaucgacguccucugggccuccaacuccauggucgcccucugcggcucccgcgagcgccucggcuccugguccuggcacgacggcgccgagaucaucuacuucaaguga

SEQ ID NO: 117512 - RNA, 1380 nt, Artificial Sequence
  derived and/or modified sequence opt2 from neuraminidase__InfluenzaA__ALO75898
augaaccccaaccagaagaucaccugcaucuccgccaccggcgucacccucuccgucgucucccuccucaucggcaucgccaaccucggccucaacaucggccuccacuacaaggucuccgacuccaccaccaucaacauccccaacaugaacgagaccaaccccaccaccaccaacaucaccaacaucaucgucaacaagaacgaggagcgcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggucggcaacauccuccgcacccaggaguccgagugcgucugccacaagggcaucugccccgucgucaugaccgacggccccgccaacaacaaggccgccaccaagaucaucuacuucaaggagggcaagauccagaagaucgaggagcuccagggcaacgcccagcacaucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccuccuaccagcucaucgucaacaaccagaacugguccggcuacuccggcgccuucaucgacuacugggccaacaaggagugcuucaaccccugcuucuacgucgagcucauccgcggccgccccaaggagaucgacguccucugggccuccaacuccauggucgcccucugcggcucccgcgagcgccucggcuccugguccuggcacgacggcgccgagaucaucuacuucaaguga

SEQ ID NO: 117513 - RNA, 1380 nt, Artificial Sequence; identical to SEQ ID NO: 117512
  derived and/or modified sequence opt2 from neuraminidase__InfluenzaA__ALO75910

SEQ ID NO: 117514 - RNA, 1380 nt, Artificial Sequence
  derived and/or modified sequence opt2 from neuraminidase__InfluenzaA__ALO75922
augaaccccaaccagaagaucaccugcaucuccgccaccggcgucacccucuccgucgucucccuccucaucggcaucgccaaccucggccucaacaucggccuccacuacaaggucuccgacuccaccaccaucaacauccccaacaugaacgagaccaaccccaccaccaccaacaucaccaacaucaucgucaacaagaacgaggagcgcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggucggcaacauccuccgcacccaggaguccgagugcgucugccacaagggcaucugccccgucgucaugaccgacggccccgccaacaacaaggccgccaccaagaucaucuacuucaaggagggcaagauccagaagaucgaggagcuccagggcaacgcccagcacaucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgagcccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccuccuaccagcucaucgucaacaaccagaacugguccggcuacuccggcgccuucaucgacuacugggccaacaaggagugcuucaaccccugcuucuacgucgagcucauccgcggccgccccaaggagaucgacguccucugggccuccaacuccauggucgcccucugcggcucccgcgagcgccucggcuccugguccuggcacgacggcgccgagaucaucuacuucaaguga

SEQ ID NO: 117515 - RNA, 1401 nt, Artificial Sequence
  derived and/or modified sequence opt2 from neuraminidase__InfluenzaA__ALT20083
augaaccccaaccagcgcaucaccgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccuccggcgacaucugggucacccgcgagcccuacgucuccugcucccucaacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacgucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccaacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 117516 - RNA, 1410 nt, Artificial Sequence
  derived and/or modified sequence opt2 from neuraminidase__InfluenzaA__AMA65392
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcucccgcggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117517 - RNA, 1410 nt, Artificial Sequence
  derived and/or modified sequence opt2 from neuraminidase__InfluenzaA__AMA65394
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117518 - RNA, 1410 nt, Artificial Sequence
  derived and/or modified sequence opt2 from neuraminidase__InfluenzaA__BAA00618
augaaccccaaccagaagaucaucaccaugggcuccgucuccaucaucaucgccaucgucugccuccucaugcagaucgccauccucgucaccaccgucacccuccacuuccgccagcacgaguccgacuccccccccuccaaccaggucauccccugcgagcccaucaucaucgagcgcaacaucaccgagaucgucuaccucaacaacaccaccaucgagaaggagaccugccccaaguccgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaacucccccgucgucgacaucaacaugaaggacuacuccaucgacuccuccuacgucugcuccggccucgucggcgacaccccccgcaacgacgaccgcuccuccaaguccaacugccgcaaccccaacaacgagcgcggcaaccacggcgucaagggcugggccuucgacaacggcgacgacgucuggaugggccgcaccaucuccaaggaccuccgcuccggcuacgagaccuucaaggucaucggcggcugguccacccccaacuccaagucccagaccaaccgccaggucaucgucgacuccaacaacugguccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucgacuucaugcccaucuga

SEQ ID NO: 117519 - RNA, 1410 nt, Artificial Sequence
  derived and/or modified sequence opt2 from neuraminidase__InfluenzaA__BAA00619
augaaccccaaccagaagaucaucaccaucggcuccgucucccucaccuucgccgccaucugcuuccucaugcagaucgccauccucgucaccaccgucacccucaacuucaagcaguacgagugcgacccccccgccaccaaccaggucaugcccugcgagcccaucaucaucgagcgcaacaucaccgagaucgucuaccucaccaacaccaccaucgagcgcgagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggccgcugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcaucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacacccgcauccucuucaucgaggagggccgcaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucaacuccuccuacgucugcuccggccucgucggcgacaccccccgcaacaacgaccgcuccuccaacuccuacugccagaaccccaacaacgagaagggcaaccacggcgucaagggcugggccuucgacgacggcaacgacgucuggaugggccgcaccaucuccgaggacucccgcuccggcuaccagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgccgccaggagacccgcgucugguggaccuccaacuccaucgucgucuucugcggcaccuccggcaccuacggcaccggcuccuggcccgacggcgccgacaucaaccucaugcccaucuga

SEQ ID NO: 117520 - RNA, 1410 nt, Artificial Sequence
  derived and/or modified sequence opt2 from neuraminidase__InfluenzaA__BAA00620
augaaccccaaccagaagaucaugaccaucggcuccgucucccucaucaucgccgccgucugcuuccucaugcagaucgccauccucgucaccaccgucacccuccacuucaagcagugcgagugcgacucccccuccaacaaccaggucaagcccugcgagcccaucaucaucgagcgcaacaucaccgagaucgucuaccucaacaacaccaccaucgagaaggagaccugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccaacguccgcugcaucugccgcgacaacuggaagggcuccaaccgccccaucgucgacaucaacaugaaggacuacuccaucgacuccuccuacgucugcuccggccucgucggcgacaccccccgcaacgacgaccgcuccuccaaguccaacugccgcaaccccaacaacgagaagggcaaccacggcgucaagggcugggccuucgacaacggcgacgacgucuggaugggccgcaccaucuccaaggaccuccgcuccggcuacgagaccuucaaggucaucggcggcugguucacccccaacuccaagucccaggucaaccgccaggucaucgucgacuccgacaaccgcuccggcuacuccggcaucuucuccgucgagggcaaguccugcaucaaccgcugcuucuacgucgagcucauccgcggccgcggccaggagacccgcgucugguggaccuccaacuccaucgucgucuucugcggcaccuccggcaccuacggcaagggcuccuggcccgacggcgccaacaucaacuucaugcccaucuga

SEQ ID NO: 117521 - RNA, 1410 nt, Artificial Sequence
  derived and/or modified sequence opt2 from neuraminidase__InfluenzaA__BAA00621
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaagaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccaacgaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 117522 - RNA, 1413 nt, Artificial Sequence
  derived and/or modified sequence opt2 from neuraminidase__InfluenzaA__BAA06714
augaaccccaaccagaagaucaucaccaucggcuccaucuccauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgccgccucauguccugcccccucggcgaggcccccucccccuacaacucccgcuucgaguccaucgccugguccgccuccgccugccacgacggcaugggcuggcucaccaucggcaucuccggccccgacgacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggccaggccuccuaccgcaucuucaagaucgagaagggcaaggucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaaccccccccccaaggacggcaagggcuccugcgaccccgucaccgucgacggcgccgacggcgucaagggcuucuccuaccgcuacggcaacggcgucuggaucggccgcaccaaguccaaccgcuuccgcaagggcuucgagaugaucugggaccccaacggcuggaccgacaccgacuccgacuuccucgucaagcaggacgucgucgccaugaccgacugguccggcuacuccggcuccuucguccagcaccccgagcucaccggccucgacugcaugcgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117523 - RNA, 1413 nt, Artificial Sequence
  derived and/or modified sequence opt2 from neuraminidase__InfluenzaA__BAA06715
augaaccccaaccagaagaucaucaccaucggcuccaucuccauggccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggcaaggucaccaaguccaucgagcucgacgcccccaacuaccacuacgaggagugcuccugcuaccccgacaccggcaccgucaugugcgucugccgcgacaacuggcacggcuccaaccgccccuccgucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 117524 - RNA, 1410 nt, Artificial Sequence
  derived and/or modified sequence opt2 from neuraminidase__InfluenzaA__BAA06716
augaacaccaaccagcgcaucaucaccaucggcaccaucugccucaucgucggcaucaucucccuccuccuccagaucggcaacaucauccuccucuggaugucccacuccauccagaccggcgagaagucccaccccaaggucugcaaccaguccgucaucaccuacgagaacaacaccugggucaaccagaccuacgucaacaucuccaacaccaacaucgccgccggccagggcgucacccccaucauccucgccggcaacuccucccucugccccaucuccggcugggccaucuacuccaaggacaacuccauccgcaucggcuccaagggcgacaucuucgucaugcgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagcucuucaagauggagaagggcaagaucaucaaguccaucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgccgcggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucaacuccggcaccgccuccugguccuggcccgacggcgccgaccuccccuucaccaucgacaaguga

SEQ ID NO: 117525 - RNA, 1413 nt, Artificial Sequence
  derived and/or modified sequence opt2 from neuraminidase__InfluenzaA__BAA06717
augaaccccaaccagaagaucaucaccaucggcuccaucuccauggccaucggcaucaucucccucauccuccagaucggcaacaucaucuccaucugggccucccacuccauccagaccggcucccagaaccacaccggcaucugcaaccagcgcaugaucaccuacgagaacuccaccugggucaaccagaccuacgucaacaucuccaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaaggucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 117526 - RNA, 1413 nt, Artificial Sequence
  derived and/or modified sequence opt2 from neuraminidase__InfluenzaA__BAA06718
augaaccccaaccagaagaucaucaccaucggcuccaucugcauggccaucggcaucaucucccucauccuccagaucggcaacaucgucuccaucuggaucucccacuccauccagaccggcucccagaacuacaccggcaucugcaaccagcgcaucaucaccuacgagaacuccaccugggucaaccagaccuacgucaacaucaacaacaccaacgucgucgccggccaggacaccaccuccgucgcccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgccgccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccaacaacggccccgccuccuaccgcaucuucaagaucgagaagggcaagaucaccaaguccaucgagcucgacgcccccaacucccacuacgaggagugcuccugcuaccccgacgccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaugaccgacugguccggcuacuccggcuccuucguccagcaccccgagcucaccggccucgacugcaugcgccccugcuucugggucgagcucguccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 117527 - RNA, 1413 nt, Artificial Sequence
  derived and/or modified sequence opt2 from neuraminidase__InfluenzaA__BAA06720
augaaccccaaccagaagaucaucaccaucggcuccaucuccauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccucggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgccgccucauguccugcccccucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggcaaggucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaaccccccccccaaggacggcaagggcuccugcaaccccgucaccgucgacggcgccgacggcgucaagggcuucuccuaccgcuacggcaacggcgucuggaucggccgcaccaaguccaaccgcuuccgcaagggcuucgagaugaucugggaccccaacggcuggaccgacaccgacuccgacuucuccgucaagcaggacgucgucgccaugaccgacugguccggcuacuccggcuccuucguccagcaccccgagcucaccggccucgacugcaugcgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117528 - RNA, 1410 nt, Artificial Sequence
  derived and/or modified sequence opt2 from neuraminidase__InfluenzaA__BAD16637
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggucaaccgccaggucaucgucggcaacaacaacugguccggcuacuccggcaucuucuccgucgagggcaaguccugcaucaaccgcugcuucuacgucgagcucauccgcggcaugccccaggagacccgcgucugguggaccuccaacuccaucgucgucuucugcggcaccuccggcaccuacggcaccggcuccuggcccgacggcgccaacaucaacuucaugcccaucuga

SEQ ID NO: 117529 - RNA, 1410 nt, Artificial Sequence
  derived and/or modified sequence opt2 from neuraminidase__InfluenzaA__BAD16638
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccacgaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 117530 - RNA, 1410 nt, Artificial Sequence; identical to SEQ ID NO: 114709
  derived and/or modified sequence opt2 from neuraminidase__InfluenzaA__BAD16639

SEQ ID NO: 117531 - RNA, 1410 nt, Artificial Sequence
  derived and/or modified sequence opt2 from neuraminidase__InfluenzaA__BAD16640
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucauggacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 117532 - RNA, 1410 nt, Artificial Sequence
  derived and/or modified sequence opt2 from neuraminidase__InfluenzaA__BAD16641
augaaccccaaccagaagaucaucaccaucggcuccgccucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaccaccgagaucgucuaccucaacaacaccaccaucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagaagggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaaccucaugcccaucuga

SEQ ID NO: 117533 - RNA, 1410 nt, Artificial Sequence
  derived and/or modified sequence opt2 from neuraminidase__InfluenzaA__BAD16642
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgacaaggagaagugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 117534 - RNA, 1410 nt, Artificial Sequence
  derived and/or modified sequence opt2 from neuraminidase__InfluenzaA__BAD16643
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggccucuucacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 117535 - RNA, 1410 nt, Artificial Sequence
  derived and/or modified sequence opt2 from neuraminidase__InfluenzaA__BAD16644
augaaccccaaccagaagaucaucaccaucggcuccgucucccucaccaucgccaccaucugcuuccucaugcagaucgccauccucgucaccaccgucacccuccacuucaagcaguacgagugcgacuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccuggucccgcuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcugcgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 117536 - RNA, 1410 nt, Artificial Sequence; identical to SEQ ID NO: 106088
  derived and/or modified sequence opt2 from neuraminidase__InfluenzaA__BAD16645

SEQ ID NO: 117537 - RNA, 1410 nt, Artificial Sequence; identical to SEQ ID NO: 114056
  derived and/or modified sequence opt2 from neuraminidase__InfluenzaA__BAD16646

SEQ ID NO: 117538 - RNA, 1410 nt, Artificial Sequence; identical to SEQ ID NO: 106088
  derived and/or modified sequence opt2 from neuraminidase__InfluenzaA__BAD16647

SEQ ID NO: 117539 - RNA, 1410 nt, Artificial Sequence
  derived and/or modified sequence opt2 from neuraminidase__InfluenzaA__BAD16648
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucuacggcaccugcaccgucgucaugaccgacggcuccgccuccgagcgcgccgagaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 117540 - RNA, 1410 nt, Artificial Sequence
  derived and/or modified sequence opt2 from neuraminidase__InfluenzaA__BAE07203
augaaccccaaccagaagaucaccaccaucggcuccaucugcauggucaucggcaucgucucccucaugcuccagaucggcaacaucaucuccaucugggucucccacuccauccagaccggcaaccagcaccaggccgagcccugcaaccaguccaucaucaccuacgagaacaacaccugggucaaccagaccuacgucaacaucuccaacaccaacuuccucaccgagaaggccgucgccuccgucacccucgccggcaacuccucccucugccccaucuccggcugggccgucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccaacggccaggccuccuacaagaucuuccgcaucgagaagggcaaggucgucaaguccgccgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccgcaucggcuacaucugcuccggcgucuucggcgacaacccccgccccaacgacggcaccggcuccugcggccccgucucccccaagggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 117541 - RNA, 1410 nt, Artificial Sequence
  derived and/or modified sequence opt2 from neuraminidase__InfluenzaA__BAF46322
augaaccccaaccccaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117542 - RNA, 1410 nt, Artificial Sequence; identical to SEQ ID NO: 106226
  derived and/or modified sequence opt2 from neuraminidase__InfluenzaA__BAF46323

SEQ ID NO: 117543 - RNA, 1410 nt, Artificial Sequence
  derived and/or modified sequence opt2 from neuraminidase__InfluenzaA__BAF46324
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaucguccacgaccgcacccccuaccgcacccuccucaugaacgagcucggcguccccuuccaccucggcaccaagcaggucugcaucgccugguccuccuccuccugccacgacggcaaggccuggcuccacgucugggucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117544 - RNA, 1410 nt, Artificial Sequence
  derived and/or modified sequence opt2 from neuraminidase__InfluenzaA__BAF46332
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccaccacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117545 - RNA, 1410 nt, Artificial Sequence
  derived and/or modified sequence opt2 from neuraminidase__InfluenzaA__BAF46334
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117546 - RNA, 1410 nt, Artificial Sequence; identical to SEQ ID NO: 117545
  derived and/or modified sequence opt2 from neuraminidase__InfluenzaA__BAF46335

SEQ ID NO: 117547 - RNA, 1410 nt, Artificial Sequence
  derived and/or modified sequence opt2 from neuraminidase__InfluenzaA__BAF46337
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcguccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggauggcccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117548 - RNA, 1410 nt, Artificial Sequence; identical to SEQ ID NO: 117545
  derived and/or modified sequence opt2 from neuraminidase__InfluenzaA__BAF46345

SEQ ID NO: 117549 - RNA, 1410 nt, Artificial Sequence
  derived and/or modified sequence opt2 from neuraminidase__InfluenzaA__BAF46346
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucgccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcgucaucugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117550 - RNA, 1410 nt, Artificial Sequence
  derived and/or modified sequence opt2 from neuraminidase__InfluenzaA__BAF46347
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccaccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117551 - RNA, 1410 nt, Artificial Sequence
  derived and/or modified sequence opt2 from neuraminidase__InfluenzaA__BAF46349
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgcccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucuucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117552 - RNA, 1410 nt, Artificial Sequence; identical to SEQ ID NO: 117545
  derived and/or modified sequence opt2 from neuraminidase__InfluenzaA__BAF46350

SEQ ID NO: 117553 - RNA, 1410 nt, Artificial Sequence
  derived and/or modified sequence opt2 from neuraminidase__InfluenzaA__BAF46351
augaaccccauccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccauggucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117554 - RNA, 1410 nt, Artificial Sequence
  derived and/or modified sequence opt2 from neuraminidase__InfluenzaA__BAF46368
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117555 - RNA, 1410 nt, Artificial Sequence
  derived and/or modified sequence opt2 from neuraminidase__InfluenzaA__BAF46369
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggcaagcucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuuccaggucaucgagggcugguccaacuccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117556 - RNA, 1410 nt, Artificial Sequence
  derived and/or modified sequence opt2 from neuraminidase__InfluenzaA__BAF46370
augaaccccaaccagaagaucaucaccaucggcuccgucucccucaccaucuccaccaucugcuucuucaugcagaucgccauccucaucaccaccgucacccuccacuucaagcaguacgaguucaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaccuccaucgucgucuucugcggcuccuccggcaccuacggcaccggcuccuggcccgacggcgccgacaucaaccucaugcccaucuga

SEQ ID NO: 117557 - RNA, 1410 nt, Artificial Sequence
  derived and/or modified sequence opt2 from neuraminidase__InfluenzaA__BAF46371
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucguccaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcuccaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117558 - RNA, 1410 nt, Artificial Sequence
  derived and/or modified sequence opt2 from neuraminidase__InfluenzaA__BAF46372
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucgccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117559 - RNA, 1410 nt, Artificial Sequence
  derived and/or modified sequence opt2 from neuraminidase__InfluenzaA__BAF46385
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccccgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcgcccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccuccaccuacggcaccggcuccuggcccgacggcgccgacaucaaccucaugcccaucuga

SEQ ID NO: 117560 - RNA, 1410 nt, Artificial Sequence
  derived and/or modified sequence opt2 from neuraminidase__InfluenzaA__BAF46386
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccuccaccuacggcaccggcuccuggcccgacggcgccgacaucaaccucaugcccaucuga

SEQ ID NO: 117561 - RNA, 1410 nt, Artificial Sequence; identical to SEQ ID NO: 108076
  derived and/or modified sequence opt2 from neuraminidase__InfluenzaA__BAF46387

SEQ ID NO: 117562 - RNA, 1410 nt, Artificial Sequence
  derived and/or modified sequence opt2 from neuraminidase__InfluenzaA__BAF46388
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggacaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 117563 - RNA, 1410 nt, Artificial Sequence
  derived and/or modified sequence opt2 from neuraminidase__InfluenzaA__BAF47922
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacauccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117564 - RNA, 1410 nt, Artificial Sequence; identical to SEQ ID NO: 106206
  derived and/or modified sequence opt2 from neuraminidase__InfluenzaA__BAF47923

SEQ ID NO: 117565 - RNA, 1410 nt, Artificial Sequence
  derived and/or modified sequence opt2 from neuraminidase__InfluenzaA__BAF47924
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacuccgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117566 - RNA, 1410 nt, Artificial Sequence; identical to SEQ ID NO: 106224
  derived and/or modified sequence opt2 from neuraminidase__InfluenzaA__BAF47925

SEQ ID NO: 117567 - RNA, 1410 nt, Artificial Sequence; identical to SEQ ID NO: 106224
  derived and/or modified sequence opt2 from neuraminidase__InfluenzaA__BAF47926

SEQ ID NO: 117568 - RNA, 1410 nt, Artificial Sequence; identical to SEQ ID NO: 112211
  derived and/or modified sequence opt2 from neuraminidase__InfluenzaA__BAF47927

SEQ ID NO: 117569 - RNA, 1410 nt, Artificial Sequence; identical to SEQ ID NO: 108076
  derived and/or modified sequence opt2 from neuraminidase__InfluenzaA__BAF47928

SEQ ID NO: 117570 - RNA, 1410 nt, Artificial Sequence
  derived and/or modified sequence opt2 from neuraminidase__InfluenzaA__BAF47929
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaccgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccgacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 117571 - RNA, 1410 nt, Artificial Sequence
  derived and/or modified sequence opt2 from neuraminidase__InfluenzaA__BAF47930
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaccgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117572 - RNA, 1410 nt, Artificial Sequence; identical to SEQ ID NO: 112211
  derived and/or modified sequence opt2 from neuraminidase__InfluenzaA__BAF47931

SEQ ID NO: 117573 - RNA, 1410 nt, Artificial Sequence
  derived and/or modified sequence opt2 from neuraminidase__InfluenzaA__BAF47932
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117574 - RNA, 1410 nt, Artificial Sequence; identical to SEQ ID NO: 106224
  derived and/or modified sequence opt2 from neuraminidase__InfluenzaA__BAF47933

SEQ ID NO: 117575 - RNA, 1410 nt, Artificial Sequence; identical to SEQ ID NO: 106226
  derived and/or modified sequence opt2 from neuraminidase__InfluenzaA__BAF47934

SEQ ID NO: 117576 - RNA, 1410 nt, Artificial Sequence; identical to SEQ ID NO: 106226
  derived and/or modified sequence opt2 from neuraminidase__InfluenzaA__BAF47935

SEQ ID NO: 117577 - RNA, 1410 nt, Artificial Sequence
  derived and/or modified sequence opt2 from neuraminidase__InfluenzaA__BAF47936
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117578 - RNA, 1410 nt, Artificial Sequence
  derived and/or modified sequence opt2 from neuraminidase__InfluenzaA__BAF47937
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117579 - RNA, 1410 nt, Artificial Sequence
  derived and/or modified sequence opt2 from neuraminidase__InfluenzaA__BAF47938
augaaccccaaccagaagaucaucaccaucggcuccgucucccucaccaucuccaccaucugcuucuucaugcagaucgccauccucaucaccaccgucacccuccacuucaagcaguacgaguucaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117580 - RNA, 1410 nt, Artificial Sequence; identical to SEQ ID NO: 106226
  derived and/or modified sequence opt2 from neuraminidase__InfluenzaA__BAF47939

SEQ ID NO: 117581 - RNA, 1410 nt, Artificial Sequence
  derived and/or modified sequence opt2 from neuraminidase__InfluenzaA__BAF47940
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggagaagaccgagguccucuggaccuccaacuccaucgucgucuucugcggcaccuccggcaccuacggcaccggcuccuggcccgacggcgccgacaucaaccucaugcccaucuga

SEQ ID NO: 117582 - RNA, 1410 nt, Artificial Sequence; identical to SEQ ID NO: 106224
  derived and/or modified sequence opt2 from neuraminidase__InfluenzaA__BAF47941

SEQ ID NO: 117583 - RNA, 1410 nt, Artificial Sequence
  derived and/or modified sequence opt2 from neuraminidase__InfluenzaA__BAF47943
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaucgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117584 - RNA, 1410 nt, Artificial Sequence
  derived and/or modified sequence opt2 from neuraminidase__InfluenzaA__BAF47944
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucaccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgaccccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117585 - RNA, 1410 nt, Artificial Sequence
  derived and/or modified sequence opt2 from neuraminidase__InfluenzaA__BAF47945
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaagcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117586 - RNA, 1410 nt, Artificial Sequence
  derived and/or modified sequence opt2 from neuraminidase__InfluenzaA__BAF47946
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaagguccucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117587 - RNA, 1410 nt, Artificial Sequence
  derived and/or modified sequence opt2 from neuraminidase__InfluenzaA__BAF47948
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaagguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaacuccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117588 - RNA, 1410 nt, Artificial Sequence
  derived and/or modified sequence opt2 from neuraminidase__InfluenzaA__BAF47949
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaagguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117589 - RNA, 1410 nt, Artificial Sequence; identical to SEQ ID NO: 106226
  derived and/or modified sequence opt2 from neuraminidase__InfluenzaA__BAF47950

SEQ ID NO: 117590 - RNA, 1410 nt, Artificial Sequence
  derived and/or modified sequence opt2 from neuraminidase__InfluenzaA__BAF47951
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaacuccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117591 - RNA, 1410 nt, Artificial Sequence
  derived and/or modified sequence opt2 from neuraminidase__InfluenzaA__BAF47952
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 117592 - RNA, 1410 nt, Artificial Sequence
  derived and/or modified sequence opt2 from neuraminidase__InfluenzaA__BAF47953
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117593 - RNA, 1410 nt, Artificial Sequence; identical to SEQ ID NO: 117545
  derived and/or modified sequence opt2 from neuraminidase__InfluenzaA__BAF47954

SEQ ID NO: 117594 - RNA, 1410 nt, Artificial Sequence; identical to SEQ ID NO: 117545
  derived and/or modified sequence opt2 from neuraminidase__InfluenzaA__BAF47955

SEQ ID NO: 117595 - RNA, 1410 nt, Artificial Sequence
  derived and/or modified sequence opt2 from neuraminidase__InfluenzaA__BAF47956
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaacuucaugcccaucuga

SEQ ID NO: 117596 - RNA, 1410 nt, Artificial Sequence
  derived and/or modified sequence opt2 from neuraminidase__InfluenzaA__BAF47958
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccucaugaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggaccgacggcgccgacaucaacuucaugcccaucuga

SEQ ID NO: 117597 - RNA, 1410 nt, Artificial Sequence
  derived and/or modified sequence opt2 from neuraminidase__InfluenzaA__BAF47959
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacuacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117598 - RNA, 1410 nt, Artificial Sequence
  derived and/or modified sequence opt2 from neuraminidase__InfluenzaA__BAF47960
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117599 - RNA, 1410 nt, Artificial Sequence
  derived and/or modified sequence opt2 from neuraminidase__InfluenzaA__BAF47975
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccacaugcccaucuga

SEQ ID NO: 117600 - RNA, 1410 nt, Artificial Sequence; identical to SEQ ID NO: 106224
  derived and/or modified sequence opt2 from neuraminidase__InfluenzaA__BAF47976

SEQ ID NO: 117601 - RNA, 1410 nt, Artificial Sequence
  derived and/or modified sequence opt2 from neuraminidase__InfluenzaA__BAF47977
augaaccccaaccagaagaucaucaccaucggcuccgucucccucaccaucuccaccaucugcuucuucaugcagaucgccauccucaucaccaccgucacccuccaguucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117602 - RNA, 1410 nt, Artificial Sequence
  derived and/or modified sequence opt2 from neuraminidase__InfluenzaA__BAF47978
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgccuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117603 - RNA, 1410 nt, Artificial Sequence
  derived and/or modified sequence opt2 from neuraminidase__InfluenzaA__BAF47979
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117604 - RNA, 1410 nt, Artificial Sequence; identical to SEQ ID NO: 108076
  derived and/or modified sequence opt2 from neuraminidase__InfluenzaA__BAF47980

SEQ ID NO: 117605 - RNA, 1410 nt, Artificial Sequence
  derived and/or modified sequence opt2 from neuraminidase__InfluenzaA__BAF47981
augaaccccaaccagaagaucaucaccaucggcuccgucucccucaccaucuccaccaucugccucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117606 - RNA, 1410 nt, Artificial Sequence
  derived and/or modified sequence opt2 from neuraminidase__InfluenzaA__BAF47982
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117607 - RNA, 1410 nt, Artificial Sequence; identical to SEQ ID NO: 108076
  derived and/or modified sequence opt2 from neuraminidase__InfluenzaA__BAF47983

SEQ ID NO: 117608 - RNA, 1410 nt, Artificial Sequence
  derived and/or modified sequence opt2 from neuraminidase__InfluenzaA__BAF47984
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117609 - RNA, 1410 nt, Artificial Sequence
  derived and/or modified sequence opt2 from neuraminidase__InfluenzaA__BAF47985
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117610 - RNA, 1410 nt, Artificial Sequence
  derived and/or modified sequence opt2 from neuraminidase__InfluenzaA__BAF47986
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgccgcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117611 - RNA, 1410 nt, Artificial Sequence
  derived and/or modified sequence opt2 from neuraminidase__InfluenzaA__BAF47987
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaagguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117612 - RNA, 1410 nt, Artificial Sequence; identical to SEQ ID NO: 106226
  derived and/or modified sequence opt2 from neuraminidase__InfluenzaA__BAF47988

SEQ ID NO: 117613 - RNA, 1410 nt, Artificial Sequence; identical to SEQ ID NO: 106226
  derived and/or modified sequence opt2 from neuraminidase__InfluenzaA__BAF47989

SEQ ID NO: 117614 - RNA, 1410 nt, Artificial Sequence
  derived and/or modified sequence opt2 from neuraminidase__InfluenzaA__BAF47990
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucaucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccgucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117615 - RNA, 1410 nt, Artificial Sequence
  derived and/or modified sequence opt2 from neuraminidase__InfluenzaA__BAF47991
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaucguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcauccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117616 - RNA, 1410 nt, Artificial Sequence
  derived and/or modified sequence opt2 from neuraminidase__InfluenzaA__BAF47992
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgagcccgacaagugcuaccccuucgcccucguccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccuucgucgucuucugcggcaccuccggcaccuacggcaccggcuccuggcccgacggcgccgacaucaaccucaugcccaucuga

SEQ ID NO: 117617 - RNA, 1410 nt, Artificial Sequence; identical to SEQ ID NO: 117573
  derived and/or modified sequence opt2 from neuraminidase__InfluenzaA__BAF47993

SEQ ID NO: 117618 - RNA, 1410 nt, Artificial Sequence; identical to SEQ ID NO: 106224
  derived and/or modified sequence opt2 from neuraminidase__InfluenzaA__BAF47994

SEQ ID NO: 117619 - RNA, 1410 nt, Artificial Sequence
  derived and/or modified sequence opt2 from neuraminidase__InfluenzaA__BAF47995
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117620 - RNA, 1410 nt, Artificial Sequence; identical to SEQ ID NO: 117619
  derived and/or modified sequence opt2 from neuraminidase__InfluenzaA__BAF47996

SEQ ID NO: 117621 - RNA, 1410 nt, Artificial Sequence; identical to SEQ ID NO: 106226
  derived and/or modified sequence opt2 from neuraminidase__InfluenzaA__BAF47997

SEQ ID NO: 117622 - RNA, 1410 nt, Artificial Sequence
  derived and/or modified sequence opt2 from neuraminidase__InfluenzaA__BAF57504
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccuccgaccccgacaagugcuaccaguucgcccucggccagggcaccacccucaacaacguccacuccaacgacaccguccacgaccgcacccccuaccgcacccuccucaugaaggagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117623 - RNA, 1410 nt, Artificial Sequence
  derived and/or modified sequence opt2 from neuraminidase__InfluenzaA__BAF57508
augaaccccaaccagaagaucaucaccaucggcuccgucucccucaccaucuccaccaucugcuucuucaugcagaucgccauccucaucaccacccucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117624 - RNA, 1410 nt, Artificial Sequence; identical to SEQ ID NO: 107441
  derived and/or modified sequence opt2 from neuraminidase__InfluenzaA__BAF57511

SEQ ID NO: 117625 - RNA, 1410 nt, Artificial Sequence
  derived and/or modified sequence opt2 from neuraminidase__InfluenzaA__BAF57515
augaaccccaaccagcgcaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaagguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcuggucccaccccaacucccagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117626 - RNA, 1410 nt, Artificial Sequence
  derived and/or modified sequence opt2 from neuraminidase__InfluenzaA__BAF57522
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaucaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgaccgcucccgcuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcaccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117627 - RNA, 1410 nt, Artificial Sequence
  derived and/or modified sequence opt2 from neuraminidase__InfluenzaA__BAF57529
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaagguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117628 - RNA, 1410 nt, Artificial Sequence; identical to SEQ ID NO: 113063
  derived and/or modified sequence opt2 from neuraminidase__InfluenzaA__BAF57532

SEQ ID NO: 117629 - RNA, 1410 nt, Artificial Sequence; identical to SEQ ID NO: 113063
  derived and/or modified sequence opt2 from neuraminidase__InfluenzaA__BAF57536

SEQ ID NO: 117630 - RNA, 1410 nt, Artificial Sequence
  derived and/or modified sequence opt2 from neuraminidase__InfluenzaA__BAF57539
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucaucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggagaagaccgagguccucuggaccuccaacuccaucgucgucuucugcggcaccuccggcaccuacggcaccggcuccuggcccgacggcgccgacaucaaccucaugcccaucuga

SEQ ID NO: 117631 - RNA, 1410 nt, Artificial Sequence
  derived and/or modified sequence opt2 from neuraminidase__InfluenzaA__BAF57543
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccgccaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117632 - RNA, 1410 nt, Artificial Sequence
  derived and/or modified sequence opt2 from neuraminidase__InfluenzaA__BAF57547
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgaggcccucuggaccuccaacuccaucgucgucuucugcggcaccuccggcaccuacggcaccggcuccuggcccgacggcgccgacaucaaccucaugcccaucuga

SEQ ID NO: 117633 - RNA, 1410 nt, Artificial Sequence; identical to SEQ ID NO: 106226
  derived and/or modified sequence opt2 from neuraminidase__InfluenzaA__BAF57551

SEQ ID NO: 117634 - RNA, 1410 nt, Artificial Sequence; identical to SEQ ID NO: 106226
  derived and/or modified sequence opt2 from neuraminidase__InfluenzaA__BAF57555

SEQ ID NO: 117635 - RNA, 1410 nt, Artificial Sequence; identical to SEQ ID NO: 106224
  derived and/or modified sequence opt2 from neuraminidase__InfluenzaA__BAF57559

SEQ ID NO: 117636 - RNA, 1410 nt, Artificial Sequence
  derived and/or modified sequence opt2 from neuraminidase__InfluenzaA__BAF57563
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaucguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117637 - RNA, 1410 nt, Artificial Sequence; identical to SEQ ID NO: 106224
  derived and/or modified sequence opt2 from neuraminidase__InfluenzaA__BAF57571

SEQ ID NO: 117638 - RNA, 1410 nt, Artificial Sequence; identical to SEQ ID NO: 112968
  derived and/or modified sequence opt2 from neuraminidase__InfluenzaA__BAF57575

SEQ ID NO: 117639 - RNA, 1410 nt, Artificial Sequence; identical to SEQ ID NO: 105839
  derived and/or modified sequence opt2 from neuraminidase__InfluenzaA__BAF57579

SEQ ID NO: 117640 - RNA, 1410 nt, Artificial Sequence
  derived and/or modified sequence opt2 from neuraminidase__InfluenzaA__BAF57583
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacauccgcgucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117641 - RNA, 1410 nt, Artificial Sequence
  derived and/or modified sequence opt2 from neuraminidase__InfluenzaA__BAF57587
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117642 - RNA, 1410 nt, Artificial Sequence
  derived and/or modified sequence opt2 from neuraminidase__InfluenzaA__BAF57591
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucguccacaucaacaucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117643 - RNA, 1410 nt, Artificial Sequence
  derived and/or modified sequence opt2 from neuraminidase__InfluenzaA__BAF57595
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagaucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcgucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 117644 - RNA, 1410 nt, Artificial Sequence; identical to SEQ ID NO: 112968
  derived and/or modified sequence opt2 from neuraminidase__InfluenzaA__BAF57599

SEQ ID NO: 117645 - RNA, 1410 nt, Artificial Sequence
  derived and/or modified sequence opt2 from neuraminidase__InfluenzaA__BAF57603
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccgacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucggcaccuccaacuccaucgucgucuucugcggcaccuccggcaccuacggcaccggcuccuggcccgacggcgccgacaucaaccucaugcccaucuga

SEQ ID NO: 117646 - RNA, 1410 nt, Artificial Sequence; identical to SEQ ID NO: 113063
  derived and/or modified sequence opt2 from Neuraminidase__InfluenzaA__BAF62620

SEQ ID NO: 117647 - RNA, 1413 nt, Artificial Sequence
  derived and/or modified sequence opt2 from neuraminidase__InfluenzaA__BAF63036
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117648 - RNA, 1413 nt, Artificial Sequence; identical to SEQ ID NO: 112953
  derived and/or modified sequence opt2 from neuraminidase__InfluenzaA__BAF63040

SEQ ID NO: 117649 - RNA, 1413 nt, Artificial Sequence
  derived and/or modified sequence opt2 from neuraminidase__InfluenzaA__BAF63047
augaaccccaaccagaagaucaucaccaucggcuccaucuccaucgccaucggcaucaucucccucguccuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccgacugguccuggcccgacggcgccgagcuccccuucaccaucgacaaguga

SEQ ID NO: 117650 - RNA, 1413 nt, Artificial Sequence
  derived and/or modified sequence opt2 from neuraminidase__InfluenzaA__BAF63058
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcgccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacgaggccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccccaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagauggucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 117651 - RNA, 1413 nt, Artificial Sequence; identical to SEQ ID NO: 112953
  derived and/or modified sequence opt2 from neuraminidase__InfluenzaA__BAF63065

SEQ ID NO: 117652 - RNA, 1413 nt, Artificial Sequence; identical to SEQ ID NO: 112953
  derived and/or modified sequence opt2 from neuraminidase__InfluenzaA__BAF63069

SEQ ID NO: 117653 - RNA, 1413 nt, Artificial Sequence; identical to SEQ ID NO: 112953
  derived and/or modified sequence opt2 from neuraminidase__InfluenzaA__BAF63079

SEQ ID NO: 117654 - RNA, 1413 nt, Artificial Sequence; identical to SEQ ID NO: 112953
  derived and/or modified sequence opt2 from neuraminidase__InfluenzaA__BAF63092

SEQ ID NO: 117655 - RNA, 1413 nt, Artificial Sequence; identical to SEQ ID NO: 112953
  derived and/or modified sequence opt2 from neuraminidase__InfluenzaA__BAF63098

SEQ ID NO: 117656 - RNA, 1413 nt, Artificial Sequence
  derived and/or modified sequence opt2 from neuraminidase__InfluenzaA__BAF63104
augaaccccaaccagaagaucaucaccaucggcuccaucuccaucgccaucggcaucaucucccucaugcuccaggucggcaucgucgucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucgcccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggccaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 117657 - RNA, 1413 nt, Artificial Sequence
  derived and/or modified sequence opt2 from neuraminidase__InfluenzaA__BAF63112
augaaccccaaccagaagaucaucaccaucggcuccaucuccaucgccaucggcaucaucucccucaugcuccaggucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucgcccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggccaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 117658 - RNA, 1413 nt, Artificial Sequence
  derived and/or modified sequence opt2 from neuraminidase__InfluenzaA__BAF63116
augaaccccaaccagaagaucaucaccaucggcuccaucuccaucgccaucggcaucaucucccucaugcuccaggucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucgcccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggccaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccccgaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 117659 - RNA, 1413 nt, Artificial Sequence
  derived and/or modified sequence opt2 from neuraminidase__InfluenzaA__BAF63124
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaagucccgcgagcucaacgcccccaacuuccacuacgaggagugcuccugcuaccccgacaccggcaccgucaugugcgucugccgcgacaacuggcacggcuccaaccgccccugggucuccuucaaccccaaccucgacuaccagaucggcuacaucugcuccggcgucgucggcgacaacccccgccccaaggacggcaagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 117660 - RNA, 1413 nt, Artificial Sequence; identical to SEQ ID NO: 113015
  derived and/or modified sequence opt2 from neuraminidase__InfluenzaA__BAF63132

SEQ ID NO: 117661 - RNA, 1413 nt, Artificial Sequence
  derived and/or modified sequence opt2 from neuraminidase__InfluenzaA__BAF63136
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117662 - RNA, 1350 nt, Artificial Sequence
  derived and/or modified sequence opt2 from neuraminidase__InfluenzaA__BAH24021
augaaccccaaccagaagaucaucaccaucggcuccaucugcauggucaucggcaucgucucccucaugcuccagaucggcaacauggucucccucugggucucccacuccauccagaccggcaaccagcaccaggucgagcccaucuccaacaccaacuuccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaugaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacggcggcaccggcuccugcggccccgucucccccaacggcgccuacggcgucaagggcuucuccuucaaguacggcaacggcgucuggaucggccgcaccaagucccccuccucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117663 - RNA, 1410 nt, Artificial Sequence; identical to SEQ ID NO: 108405
  derived and/or modified sequence opt2 from neuraminidase__InfluenzaA__BAH95825

SEQ ID NO: 117664 - RNA, 1410 nt, Artificial Sequence; identical to SEQ ID NO: 108240
  derived and/or modified sequence opt2 from neuraminidase__InfluenzaA__BAH95826

SEQ ID NO: 117665 - RNA, 1410 nt, Artificial Sequence
  derived and/or modified sequence opt2 from neuraminidase__InfluenzaA__BAJ07994
augaaccccaaccagaagaucaccaccaucggcuccaucugcauggucaucggcaucgucucccucaugcuccagaucggcaacaucaucuccaucugggucucccacuccauccagaccggcaaccagcaccaggccgagcccugcaaccaguccaucaucaccuacgagaacaacaccugggucaaccagaccuacgucaacaucuccaacaccaacuuccucaccgagaaggccgucgccuccgucacccucgccggcaacuccucccucugccccaucuccggcugggccgucuacuccaaggacaacggcauccgcaucggcuccaagggcgacgucuucgucauccgcgagcccuucaucuccugcucccaccucgagugccgcaucuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccaacggccaggccuccuacaagaucuuccgcaucgagaagggcaaggucgucaaguccgccgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccgcaucggcuacaucugcuccggcgucuucggcgacaacccccgccccaacgacggcaccggcuccugcggccccgucucccccaagggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 117666 - RNA, 1350 nt, Artificial Sequence
  derived and/or modified sequence opt2 from neuraminidase__InfluenzaA__BAK23415
augaaccccaaccagaagaucaucaccaucggcuccgucugcaugaucaucggcaucgucucccucaugcuccagaucggcaacaugaucuccaucugggucggccacuccauccagaccggcaaccagugccacgccgagcccaucuccaacaccaaguuccccaccgagaaggccgccgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcaucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117667 - RNA, 1350 nt, Artificial Sequence
  derived and/or modified sequence opt2 from neuraminidase__InfluenzaA__BAK23416
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgccucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117668 - RNA, 1350 nt, Artificial Sequence
  derived and/or modified sequence opt2 from neuraminidase__InfluenzaA__BAK23417
augaaccccaaccagaagaucaucaccaucggcuccaucugcauggucaucggcaucgucucccucaugcuccagaucggcaacaugaucuccaucugggucucccacuccauccagaccggcaaccagugccaguccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 117669 - RNA, 1350 nt, Artificial Sequence
  derived and/or modified sequence opt2 from neuraminidase__InfluenzaA__BAK23418
augaaccccaaccagaccaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117670 - RNA, 1350 nt, Artificial Sequence; identical to SEQ ID NO: 108089
  derived and/or modified sequence opt2 from neuraminidase__InfluenzaA__BAK23420

SEQ ID NO: 117671 - RNA, 1350 nt, Artificial Sequence; identical to SEQ ID NO: 108089
  derived and/or modified sequence opt2 from neuraminidase__InfluenzaA__BAK23421

SEQ ID NO: 117672 - RNA, 1350 nt, Artificial Sequence
  derived and/or modified sequence opt2 from neuraminidase__InfluenzaA__BAK23422
augaaccccaaccagaagaucaucaccaucggcuccgucugcauggucaucggcaucgucucccucaugcuccagaucggcaacaugaucuccaucugggucggccacuccauccagaccggcaaccagugccacgccgagcccaucuccaacaccaaguuccccaccgagaaggccgccgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117673 - RNA, 1350 nt, Artificial Sequence
  derived and/or modified sequence opt2 from neuraminidase__InfluenzaA__BAK23423
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaccaccaaguuccucaccgagaaggccgucgccuccgucacccucgccggcaacuccucccucugccccaucuccggcugggccgucuacuccaaggacaacuccauccgcaucggcccccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117674 - RNA, 1350 nt, Artificial Sequence
  derived and/or modified sequence opt2 from neuraminidase__InfluenzaA__BAK23424
augaaccccaaccagaagaucaucaccaucggcuccaucugcauggucaucggcaucgucucccucaugcuccagaucggcaacaugaucuccaucugggucucccacuccauccagaccggcaaccagugccagggcgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuucuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccggcaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117675 - RNA, 1350 nt, Artificial Sequence
  derived and/or modified sequence opt2 from neuraminidase__InfluenzaA__BAK23425
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaucggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117676 - RNA, 1350 nt, Artificial Sequence
  derived and/or modified sequence opt2 from neuraminidase__InfluenzaA__BAK23426
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguucuucaccgagaaggccgucgccuccgucacccucgccggcaacuccucccucugccccaucuccggcugggccgucuacuccaaggacaacuccauccgcaucggcucccgcggcgacgucuucaucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117677 - RNA, 1350 nt, Artificial Sequence; identical to SEQ ID NO: 117675
  derived and/or modified sequence opt2 from neuraminidase__InfluenzaA__BAK23427

SEQ ID NO: 117678 - RNA, 1350 nt, Artificial Sequence
  derived and/or modified sequence opt2 from neuraminidase__InfluenzaA__BAK23428
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccgucuccgucaagcaggacaucgucgccaucaccgacugguccggcuacuccggcuccuucguccagcaccccgagcucaccggccucgacugcauccgccccugcuuccgcgucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117679 - RNA, 1350 nt, Artificial Sequence; identical to SEQ ID NO: 117675
  derived and/or modified sequence opt2 from neuraminidase__InfluenzaA__BAK23429

SEQ ID NO: 117680 - RNA, 1350 nt, Artificial Sequence
  derived and/or modified sequence opt2 from neuraminidase__InfluenzaA__BAK23430
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaucggcaccgacuccuccuucuccgucaagcaggacaucgucgccaucaccgacugguccggcuacuccggcuccuucguccagcaccccgagcucaccggccucgacugcaugcgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117681 - RNA, 1350 nt, Artificial Sequence
  derived and/or modified sequence opt2 from neuraminidase__InfluenzaA__BAK23431
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucuggggccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117682 - RNA, 1350 nt, Artificial Sequence; identical to SEQ ID NO: 117675
  derived and/or modified sequence opt2 from neuraminidase__InfluenzaA__BAK23432

SEQ ID NO: 117683 - RNA, 1350 nt, Artificial Sequence; identical to SEQ ID NO: 117675
  derived and/or modified sequence opt2 from neuraminidase__InfluenzaA__BAK23433

SEQ ID NO: 117684 - RNA, 1410 nt, Artificial Sequence
  derived and/or modified sequence opt2 from neuraminidase__InfluenzaA__BAM65748
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuuccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucggcggcugguccaaccccaacuccaagucccagaucaaccgccaggucaucgucgacaugggcaaccgcuccggcuacuccggcaucuucuccgucgagggcaaguccugcaucaaccgcugcuucuacgucgagcucauccgcggccgcaaggacgagaccgagguccucuggaccuccaacuccaucgucgucuucugcggcaccuccggcaccuacggcaccggcuccuggcccgacggcgccgacaucaagcucauguccaucuga

SEQ ID NO: 117685 - RNA, 1350 nt, Artificial Sequence
  derived and/or modified sequence opt2 from neuraminidase__InfluenzaA__BAM85817
augaaccccaaccagaagaucaucaccaucggcuccaucugcauggucaccggcaucgucucccucaugcuccagaucggcaacaugaucuccaucugggucucccacuccauccacaccggcaaccagcaccaguccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccaacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 117686 - RNA, 1350 nt, Artificial Sequence
  derived and/or modified sequence opt2 from neuraminidase__InfluenzaA__BAM85818
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117687 - RNA, 1350 nt, Artificial Sequence
  derived and/or modified sequence opt2 from neuraminidase__InfluenzaA__BAM85819
augaaccccaaccagaagaucaucaccaucggcuccaucugcauggucaucggcaucgucucccucaugcuccagaucggcaacaugaucuccaucugggucucccacuccauccagaccggcaaccagaaccaggucgagcccaucaucaacaccaacuuccucaccgagaaggccgucgccuccaucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccacaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucuccuccgacaccgucuccugguccuggcccgacggcgccgagcuccccuucaccaucgacaaguga

SEQ ID NO: 117688 - RNA, 1350 nt, Artificial Sequence
  derived and/or modified sequence opt2 from neuraminidase__InfluenzaA__BAM85820
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccaucuccaacaccaacuuccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117689 - RNA, 1350 nt, Artificial Sequence; identical to SEQ ID NO: 106520
  derived and/or modified sequence opt2 from neuraminidase__InfluenzaA__BAM85821

SEQ ID NO: 117690 - RNA, 1350 nt, Artificial Sequence
  derived and/or modified sequence opt2 from neuraminidase__InfluenzaA__BAM85822
augaaccccaaccagaagaucaucaccaucggcuccaucugcauggucaccggcaucgucucccucaugcuccagaucggcaacaugaucuccaucugggucucccacuccauccacaccggcaaccagcaccaguccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgccugcgucaacggcuccugcuucaccgucaugaccgacggccccuccaacucccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 117691 - RNA, 1410 nt, Artificial Sequence
  derived and/or modified sequence opt2 from neuraminidase__InfluenzaA__BAM85823
augaaccccaaccagaagaucaccaccaucggcuccaucugcauggucaucggcaucgucucccucaugcuccagaucggcaacaucaucuccaucugggucucccacuccauccagaccggcaaccagcaccaggccggccccugcaaccaguccaucaucaccuacgagaacaacaccugggucaaccagaccuacgucaacaucuccaacaccaacuuccucaccgagaagaccgucgccuccgucacccucgccggcaacuccucccucugccccaucuccggcugggccgucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccaacggccaggccuccuacaagaucuuccgcaucgagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcaucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 117692 - RNA, 1350 nt, Artificial Sequence
  derived and/or modified sequence opt2 from neuraminidase__InfluenzaA__BAM85824
augaaccccaaccagaagaucaucaccaucggcuccaucugcauggucaucggcaucgucucccuccuccuccagaucggcaacaugaucuccaucuggaucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccuccgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccauguuccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117693 - RNA, 1350 nt, Artificial Sequence
  derived and/or modified sequence opt2 from neuraminidase__InfluenzaA__BAM85825
augaaccccaaccagaagaucaucaccaucggcuccaucugcauggucaucggcaucgucucccucaugcuccagaucggcaacaugaucuccaucugggucucccacuccauccagaccggcaaccagaaccaggucgagcccaucaucaacaccaacuuccucaccgagaaggccgucgccuccaucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccacaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucuccugguccuggcccgacggcgccgagcuccccuucaccaucgacaaguga

SEQ ID NO: 117694 - RNA, 1350 nt, Artificial Sequence
  derived and/or modified sequence opt2 from neuraminidase__InfluenzaA__BAM85826
augaaccccaaccagaagaucaucaccaucggcuccaucugcauggucaucggcaucgucucccucaugcuccagaucggcaacaugaucuccaucugggucucccacuccauccagaccggcaaccagcgccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccucaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117695 - RNA, 1350 nt, Artificial Sequence
  derived and/or modified sequence opt2 from neuraminidase__InfluenzaA__BAM85827
augaaccccaaccagaagaucaucaccaucggcuccaucugcauggucaucggcgucgucucccucaugcuccagaccggcaacaucaucuccaucugggucucccacuccauccagaagggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaccucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucgacuccgacaccgucuccugguccuggcccgacggcgccgagcuccccuucaccaucgacaaguga

SEQ ID NO: 117696 - RNA, 1350 nt, Artificial Sequence
  derived and/or modified sequence opt2 from neuraminidase__InfluenzaA__BAM85828
augaaccccaaccagaagaucaucaccaucggcuccaucugcauggucaucggcaucgucucccucaugcuccagaucggcaacaugaucuccaucugggucucccacuccauccagaccggcaaccagcgccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117697 - RNA, 1350 nt, Artificial Sequence
  derived and/or modified sequence opt2 from neuraminidase__InfluenzaA__BAM85829
augaaccccaaccagaagaucaucaccaucggcuccaucugcaugaucaucggcaucgucucccucaugcuccagaucggcaacaucaucuccaucugggucucccacuccauccagaccggcaaccagcaccaggccgagcccaucuccgacaccaacuuccucaccgagaaggccgucgccuccgucauccucgccggcaacuccucccucugccacaucuccggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacuacauccuccgcacccaggaguccgagugcgccugcgucaacggcuccugcuucaccgucaugaccgacggccccuccaacggccaggccuccuacaagaucuucaagaucgagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaccccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggaccucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 117698 - RNA, 1413 nt, Artificial Sequence
  derived and/or modified sequence opt2 from neuraminidase__InfluenzaA__BAM85830
augaaccccaaccagaagaucaucaccaucggcuccaucugcauggccaucggcaccaucucccucauccuccagaucggcaacaucaucuccaucuggaucucccacuccauccagaccggcucccagaaccacaccggcaucugcaaccagcgcaucaucaccuacgagaacaacaccugggucaaccagaccuacgucaacaucuccaacaccaacgucgucgccggcaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaucaucaaguccuggcgcaagcagauccuccgcacccaggaguccgagugcgucugcgucaacggcuccugcuucaccaucaugaccgacggccccuccaacggccccgccuccuaccgcaucuucaagaucaagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacggcaacuuccucgucaagcaggacgucgucgccaugaccgacugguccggcuacuccggcuccuucguccagcaccccgagcucaccggccucgacugcaugcgccccugcuucugggucgagcucauccgcggccagccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 117699 - RNA, 1413 nt, Artificial Sequence
  derived and/or modified sequence opt2 from neuraminidase__InfluenzaA__BAM85831
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgcccccgcgacggcgagggcuccugcaaccccgucaccgccgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucggcugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117700 - RNA, 1413 nt, Artificial Sequence; identical to SEQ ID NO: 113020
  derived and/or modified sequence opt2 from neuraminidase__InfluenzaA__BAM85832

SEQ ID NO: 117701 - RNA, 1410 nt, Artificial Sequence
  derived and/or modified sequence opt2 from neuraminidase__InfluenzaA__BAM85833
augaaccccaaccagaagaucaucaccaucggcuccaccugcauggucaucggcaucaucucccucauccuccagaucggcaacaucaucuccaucugggucucccacuccauccagaccggcaaccagaaccagcccgagaccugcaaccaguccgucaucaccuacgagaacaagaccugggucaaccagaccuacgucaacaucuccaacaccaaccucgucaucgagcgcgacgucaucuccgucgcccuccucggcaacuccucccucugccccaucuccggcugggccaucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaucuccuggcucaccgucggcaucuccggccccgacaacggcgccgucgccguccucaaguacaacggcaucaucaccgacaccgucaaguccuggcgcaacaacauccuccgcacccaggaguccgagugcgccugcaucaacggcuccugcuucaccaucaugaccgacggccccuccaacggccaggccuccuacaagaucuucaagaucgagaagggcaaggucgucaaguccgucgagcucaacgcccccaacuaccacuacgaggagugcuccugcuaccccgacgccuccgagaucaugugcgucugccgcgacaacuggcacggcuccaaccgccccugggucuccuucaaccgcaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaagggcgucuggaucggccgcaccaaguccaccuccucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117702 - RNA, 1410 nt, Artificial Sequence
  derived and/or modified sequence opt2 from neuraminidase__InfluenzaA__BAM85834
augaaccccaaccagaagaucaucaccaucggcuccgucucccucaccgucgccaccgucugcuuccucaugcagaucgccauccucaccaccaccgucacccuccacuucaagcagaacgagugcuccauccccgccaacaaccaggucaugcccugcgagcccaucgucaucgagcgcaacaucaccgagaucgucuaccucaacaacaccaccaucgagaaggagaucugccucaaggccgccgaguaccgcaacugguccaagccccagugccagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucgagaacaagcacuccaacggcaccauccacgaccgcaucccccaccgcacccuccucaugaacgagcucggcguccccuuccaccucggcaccaagcaggucugcaucgccugguccuccuccuccugccacgacggcaaggccuggcuccacgucugcgucaccggcgacgaccgcaacgccaccgccuccuucaucuacgacggcaugcucgucgacuccaucggcuccuggucccagaacauccuccgcacccaggaguccgagugcgucugcaucaacggcaccugcgccgucgucaugaccgacggcuccgccuccggccgcgccgacacccgcauccucuucauccgcgagggcaagaucguccacaucuccccccucuccggcuccgcccagcacaucgaggagugcuccugcuacccccgcuaccccaucauccgcugcgucugccgcgacaacuggaagggcuccaaccgccccgucaucgacaucaacauggccgacuacuccaucgacuccuccuacgucugcuccggccucgucggcgacaccccccgcaacgacgacuccuccuccuccuccaacugccgcgaccccaacaacgagcgcggcaaccccggcgucaagggcugggccuucgacaacggcaacgacgucuggaugggccgcaccaucuccaaggacucccgcuccggcuacgagaccuuccgcgucaucggcggcugggccaccgccaacuccaagucccagaccaaccgccaggucaucgucgacaacaacaacugguccggcuacuccggcaucuucuccgucgaguccaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 117703 - RNA, 1410 nt, Artificial Sequence
  derived and/or modified sequence opt2 from neuraminidase__InfluenzaA__BAM85835
augaaccccaaccagaagaucaucaccaucggcuccgucucccucaccaucgccaccgucugcuuccucaugcagaucgccauccucgccaccaccgucacccuccacuucaagcagaacgagugcuccauccccgccaacaaccaggucguccccugcgagcccaucaucaucgagcgcaacaucaccgagaucgucuaccucaacaacaccaccaucgagaaggagaucugcuccaaggccgucgacuaccgcaacugguccaagccccagugccagaucaccggcuucgcccccuucuccaaggacaacuccauccgccucuccgccggcggcgacaucugggucacccgcgagcccuacgucuccugcgacaccuccaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcaucgccugguccuccuccuccugccacgacggcaaggccuggcuccacgucugcgucaccggcgacgaccgcaacgccaccgccuccuucaucuacaacggcaugcucgucgacuccaucggcuccuggucccagaacauccuccgcacccaggaguccgagugcgucugcaucaacggcuccugcaccgucgucaugaccgacggcuccgccuccggcaaggccgacacccgcauccucuucgucaaggagggcaagaucauccacaucuccccccucuccggcuccgcccagcacaucgaggagugcuccugcuacccccgcuaccccaacguccgcugcgucugccgcgacaacuggcgcggcuccaaccgccccgucaucgacaucaacauggccgacuacuccaucgacuccuccuacgucugcuccggccucgucggcgacaccccccgcaacgacgacaacuccuccuccuccaacugccgcgaccccaacaacgagcgcggcaaccccggcgucaagggcugggccuucgacuccggcgacgacgucuggaugggccgcaccaucucccgcgacucccgcuccggcuacgagaccuucaaggucaucggcggcugggccaccgccaacuccaagucccagaccucccgccaggucaucgucgacaacaacaacugguccggcuacuccggcgucuucuccgucgagcacaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 117704 - RNA, 1410 nt, Artificial Sequence
  derived and/or modified sequence opt2 from neuraminidase__InfluenzaA__BAM85836
augaaccccaaccagaagaucaucaccaucggcuccgucucccucaccaucgccaccaucugcuuccucaugcagaucgccauccucgccaccaccgucacccuccacuucaagcagaacggcugcuccauccccuccaacaaccaggucguccccugcgagcccaucaucgucgagcgcaacaucaccgagaucgucuaccucaacaacaccaccaucgagaaggagcucugccccaagguccucgaguaccgcgacugguccaagccccagugccagaucaccggcuucgcccccuucuccaaggacaacuccauccgccucuccgccggcggcgacaucugggucacccgcgagcccuacgucuccugcucccccgacaagugcuaccaguucgcccucggccagggcaccacccucgacaaccgccacuccaacggcaccauccacgaccgcaucccccaccgcacccuccucaugaacgagcucggcguccccuuccaccucggcaccaagcaggucugcaucgccugguccuccuccuccugccacgacggccgcgccuggcuccacgucugcgucaccggcgacgaccgcaacgccaccgccuccuucaucuacgacggcaugcucgucgacuccaucggcuccuggucccagaacauccuccgcacccaggaguccgagugcgucugcaucaacggcaccugcaccgucgucaugaccgacggcuccgccuccggccgcgccgacacccgcauccucuucgucaaggagggcaagaucguccacaucuccccccucuccggcuccgcccagcacaucgaggagugcuccugcuacccccgcuaccccgacguccgcugcgucugccgcgacaacuggaagggcuccaaccgccccaucaucgacaucaacauggccgacuacuccaucggcuccuccuacgucugcuccggccucgucggcgacaccccccgcaacgacgacuccuccuccaacuccaacugccgcgaccccaacaacgagcgcggcaaccccggcgucaagggcugggccuucgacuacggcaacgacgucuggaugggccgcaccaucuccaaggacucccgcuccggcuacgagaccuuccgcgucaucggcggcuggaccaccgccaacuccaagucccaggucaaccgccaggucaucgucgacaacuccaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 117705 - RNA, 1410 nt, Artificial Sequence
  derived and/or modified sequence opt2 from neuraminidase__InfluenzaA__BAO79717
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117706 - RNA, 1413 nt, Artificial Sequence; identical to SEQ ID NO: 106571
  derived and/or modified sequence opt2 from neuraminidase__InfluenzaA__CAA33354

SEQ ID NO: 117707 - RNA, 1404 nt, Artificial Sequence
  derived and/or modified sequence opt2 from Neuraminidase__InfluenzaA__CAB95858
augaaccccaaccagaagaucaucgcccucggcuccgucuccaucaccaucgccaccaucugccuccucaugcagaucgccauccucgccaccaccaugacccuccacuucaacgagugcaccaaccccuccaacaaccaggccaugcccugcgagcccaucaucaucgagcgcaacaucaccgagaucguccaccucaacaacaccaccaucgagaaggaguccugccccaaggucgccgaguacaagaacugguccaagccccagugccagaucaccggcuucgcccccuucuccaaggacaacuccauccgccucuccgccggcggcgacaucugggucacccgcgagcccuacgucuccugcggccucggcaacugcuaccaguucgcccucggccagggcaccacccucaacaacaagcacuccaacggcaccauccacgaccgcuccccccaccgcacccuccucaugaacgagcucggcguccccuuccaccucggcaccaagcaggucugcaucgccugguccuccuccuccugccacgacggcaaggccuggcuccacgucugcgucaccggcgacgaccgcaacgccaccgccuccaucaucuacgacggcaugcucaccgacuccaucggcuccugguccaagaacauccuccgcacccaggaguccgagugcgucugcaucaacggcaccugcaccgucgucaugaccgacggcuccgccuccggccgcgccgacaccaagauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuacaucaacgucgccgacuacuccgucgacuccuccuacgucugcuccggccucgucggcgacaccccccgcaacgacgacuccuccuccuccuccaacugccgcgaccccaacaacgagcgcggcggccccggcgucaagggcugggccuucgacaacggcaacgacgucuggaugggccgcaccaucaagaaggacucccgcuccggcuacgagaccuuccgcgucgucggcggcuggaccaccgccaacuccaagucccagaucaaccgccaggucaucgucgacuccgacaacugguccggcuacuccggcaucuucuccgucgagggcaagaccugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucauguccaucuga

SEQ ID NO: 117708 - RNA, 1404 nt, Artificial Sequence
  derived and/or modified sequence opt2 from neuraminidase__InfluenzaA__CAB95859
augaaccccaaccagaagaucaucgcccucggcuccgucuccaucaccaucgccaccaucugccuccucaugcagaucgccauccucgccaccaccaugacccuccacuucaacgagugcaccaaccccuccaacaaccaggccguccccugcgagcccaucaucaucgagcgcaacaucaccgagaucguccaccucaacaacaccaccaucgagaaggaguccugccccaaggucgccgaguacaagaacugguccaagccccagugccagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucaacaacaagcacuccaacggcaccauccacgaccgcuccccccaccgcacccuccucaugaacgagcucggcguccccuuccaccucggcaccaagcaggucugcaucgccugguccuccuccuccugccacgacggcaaggccuggcuccacgucugcgucaccggcgacgaccgcaacgccaccgccuccaucaucuacgacggcaugcucaccgacuccaucggcuccugguccaagaacauccuccgcacccaggaguccgagugcgucugcaucaacggcaccugcaccgucgucaugaccgacggcuccgccuccggccgcgccgacaccaagauccucuucauccgcgagggcaagaucguccacaucggcccccucuccggcuccgcccagcacgucgaggagugcuccugcuacccccgcuaccccgagguccgcugcgucugccgcgacaacuggaagggcuccaaccgccccguccucuacaucaacgucgccgacuacuccgucgacuccuccuacgucugcuccggccucgucggcgacaccccccgcaacgacgacuccuccuccuccuccaacugccgcgaccccaacaacgagcgcggcggccccggcgucaagggcugggccuucgacaacggcaacgacgucuggaugggccgcaccaucaagaaggacucccgcuccggcuacgagaccuuccgcgucgucggcggcuggaccaccgccaacuccaagucccagaucaaccgccaggucaucgucgacuccgacaacugguccggcuacuccggcaucuucuccgucgagggcaagaccugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucauguccaucuga

SEQ ID NO: 117709 - RNA, 1410 nt, Artificial Sequence; identical to SEQ ID NO: 106085
  derived and/or modified sequence opt2 from Neuraminidase__InfluenzaA__CAC19707

SEQ ID NO: 117710 - RNA, 1410 nt, Artificial Sequence
  derived and/or modified sequence opt2 from neuraminidase__InfluenzaA__CAD29959
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117711 - RNA, 1410 nt, Artificial Sequence
  derived and/or modified sequence opt2 from neuraminidase__InfluenzaA__CAD29960
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacguccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117712 - RNA, 1410 nt, Artificial Sequence
  derived and/or modified sequence opt2 from neuraminidase__InfluenzaA__CAD29961
augaaccccaaccagaagaucaucaccaucggcuccgucucccucaccaucuccaccaucugcuucuucaugcagaucgccauccucgucaccaccgucacccuccacuucaagcaguacgagugcaacuccccccccaacaaccaggucaugcucugcgagcccaccaucaucgagcgcaacaccaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccggccccgacggcgccgacaucaaccucaugcccaucuga

SEQ ID NO: 117713 - RNA, 1410 nt, Artificial Sequence; identical to SEQ ID NO: 113057
  derived and/or modified sequence opt2 from neuraminidase__InfluenzaA__CAD29962

SEQ ID NO: 117714 - RNA, 1410 nt, Artificial Sequence; identical to SEQ ID NO: 105796
  derived and/or modified sequence opt2 from neuraminidase__InfluenzaA__CAD29963

SEQ ID NO: 117715 - RNA, 1410 nt, Artificial Sequence; identical to SEQ ID NO: 105796
  derived and/or modified sequence opt2 from neuraminidase__InfluenzaA__CAD29964

SEQ ID NO: 117716 - RNA, 1410 nt, Artificial Sequence; identical to SEQ ID NO: 105796
  derived and/or modified sequence opt2 from neuraminidase__InfluenzaA__CAD29965

SEQ ID NO: 117717 - RNA, 1410 nt, Artificial Sequence; identical to SEQ ID NO: 105796
  derived and/or modified sequence opt2 from neuraminidase__InfluenzaA__CAD29966

SEQ ID NO: 117718 - RNA, 1410 nt, Artificial Sequence; identical to SEQ ID NO: 105552
  derived and/or modified sequence opt2 from neuraminidase__InfluenzaA__CAD29967

SEQ ID NO: 117719 - RNA, 1410 nt, Artificial Sequence; identical to SEQ ID NO: 105552
  derived and/or modified sequence opt2 from neuraminidase__InfluenzaA__CAD29968

SEQ ID NO: 117720 - RNA, 1410 nt, Artificial Sequence; identical to SEQ ID NO: 106085
  derived and/or modified sequence opt2 from neuraminidase__InfluenzaA__CAD29969

SEQ ID NO: 117721 - RNA, 1410 nt, Artificial Sequence
  derived and/or modified sequence opt2 from neuraminidase__InfluenzaA__CAD29970
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcauccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 117722 - RNA, 1410 nt, Artificial Sequence; identical to SEQ ID NO: 108067
  derived and/or modified sequence opt2 from neuraminidase__InfluenzaA__CAD29971

SEQ ID NO: 117723 - RNA, 1410 nt, Artificial Sequence
  derived and/or modified sequence opt2 from neuraminidase__InfluenzaA__CAD29972
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcgccgucgucaugaccgacggcuccgccuccggcaaggccgacaccaagauccucuucaucgaggagggcaagaucggccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagauccucuggaccuccaacuccaucgucgucuucugcggcaccuccggcaccuacggcaccggcuccuggcccgacggcgccgacaucaaccucaugcccaucuga

SEQ ID NO: 117724 - RNA, 1410 nt, Artificial Sequence
  derived and/or modified sequence opt2 from neuraminidase__InfluenzaA__CAD29973
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 117725 - RNA, 1410 nt, Artificial Sequence; identical to SEQ ID NO: 114096
  derived and/or modified sequence opt2 from neuraminidase__InfluenzaA__CAD29974

SEQ ID NO: 117726 - RNA, 1410 nt, Artificial Sequence
  derived and/or modified sequence opt2 from neuraminidase__InfluenzaA__CAD29984
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcacuacgucuccugcgaccgcgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccaccacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucaaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaggccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117727 - RNA, 1410 nt, Artificial Sequence
  derived and/or modified sequence opt2 from neuraminidase__InfluenzaA__CAD29985
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccucccgcaccuacggcaccggcuccuggcccgacggcgccgacaucaaccucaugcccaucuga

SEQ ID NO: 117728 - RNA, 1410 nt, Artificial Sequence
  derived and/or modified sequence opt2 from neuraminidase__InfluenzaA__CAD29988
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccgagaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 117729 - RNA, 1410 nt, Artificial Sequence
  derived and/or modified sequence opt2 from neuraminidase__InfluenzaA__CAD29990
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacaacuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117730 - RNA, 1410 nt, Artificial Sequence; identical to SEQ ID NO: 105573
  derived and/or modified sequence opt2 from neuraminidase__InfluenzaA__CAD29991

SEQ ID NO: 117731 - RNA, 1410 nt, Artificial Sequence
  derived and/or modified sequence opt2 from neuraminidase__InfluenzaA__CAD29992
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggaccgcuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117732 - RNA, 1410 nt, Artificial Sequence
  derived and/or modified sequence opt2 from neuraminidase__InfluenzaA__CAD29993
augaaccccaaccagaagaucaucaccaucggcuccgucucccucaccaucgccaccaccugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 117733 - RNA, 1410 nt, Artificial Sequence; identical to SEQ ID NO: 107261
  derived and/or modified sequence opt2 from neuraminidase__InfluenzaA__CAD29994

SEQ ID NO: 117734 - RNA, 1413 nt, Artificial Sequence; identical to SEQ ID NO: 107965
  derived and/or modified sequence opt2 from neuraminidase__InfluenzaA__CAD57252

SEQ ID NO: 117735 - RNA, 1413 nt, Artificial Sequence
  derived and/or modified sequence opt2 from neuraminidase__InfluenzaA__CAD57253
augaaccccaaccagaagaucaucaccaucggcuccauccgcaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaagaucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 117736 - RNA, 1413 nt, Artificial Sequence; identical to SEQ ID NO: 105908
  derived and/or modified sequence opt2 from neuraminidase__InfluenzaA__CAD57255

SEQ ID NO: 117737 - RNA, 1413 nt, Artificial Sequence
  derived and/or modified sequence opt2 from neuraminidase__InfluenzaA__CAD57256
augaaccccaaccagaagaucaucaccaucggcuccaucuccgucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117738 - RNA, 1413 nt, Artificial Sequence
  derived and/or modified sequence opt2 from neuraminidase__InfluenzaA__CAD57257
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117739 - RNA, 1413 nt, Artificial Sequence
  derived and/or modified sequence opt2 from neuraminidase__InfluenzaA__CAD57258
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagcgcaucaucaccuacgagaacuccaccugggucaaccagaccuacgucaacaucaacaacaccaacgucgucgccggcaaggacaagaccuccaugguccucgccggcaacuccucccucugccccauccgcggcugggccaucuacaccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 117740 - RNA, 1413 nt, Artificial Sequence
  derived and/or modified sequence opt2 from neuraminidase__InfluenzaA__CAD57259
augaaccccaaccagaagaucaucaccaucggcuccaucuccaucgccaucggcaucaucucccucauccuccagaucggcaacaucaucuccaucugggccucccacuccauccagaccgagucccagaaccacaccggcaucugcaaccagcgcaucaucaccuacgagaacuccaccugggucaaccagaccuacgucaacaucaacaacaccaacgucgccgccggcaaggacaagaccuccaugacccucgccggcaacuccucccucugccccauccgcggcugggccaucuacaccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgagaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 117741 - RNA, 1413 nt, Artificial Sequence
  derived and/or modified sequence opt2 from neuraminidase__InfluenzaA__CAD57264
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 117742 - RNA, 1350 nt, Artificial Sequence
  derived and/or modified sequence opt2 from neuraminidase__InfluenzaA__CBW54819
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccgcaucggcuacaucugcuccggcgucuucggcgacaacccccgccccaacgacggcaccggcuccugcggccccgucucccccaacggcgccuacggcgucaagggcuucuccuucaaguacggcgacggcgucuggaucggccgcaccaaguccaccaacucccgcuccggcuucgagauggucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117743 - RNA, 1350 nt, Artificial Sequence
  derived and/or modified sequence opt2 from neuraminidase__InfluenzaA__CBW54821
augaaccccaaccagaagaucaucaccaucggcuccaucugcaucgucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcaucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccagcccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117744 - RNA, 1410 nt, Artificial Sequence
  derived and/or modified sequence opt2 from neuraminidase__InfluenzaA__CCG47912
augaaccccaaccagaagaucaucaccaucggcuccgucucccucaccaucgccaccaugugccucuucaugcagaucgccauccucaucaccaccgucacccuccacuucaagcaguacgagugcgacucccccgccaacaaccaggucaugcccugcgagcccaucaucaucgagaagaacaucaccaagaucgucuaccucaccaacaccaccaucgagaaggaggucugccccaagcucggcgaguaccgcaacugguccaagccccagugccgcaucaccggcuucgcccccuucuccaaggacaacuccauccgccucuccgccggcggcgccaucugggucacccgcgagcccuacgucuccugcgaccccaacaagugcuaccaguucgcccucggccagggcaccacccucgacaaccgccacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacgacggcaagcucgucgacuccaucuccuccuggucccagaacauccuccgcacccaggaguccgagugcgucugcaucaacggcaucugcaccgucgucaugaccgacggcuccgccuccggcaaggccgacaccaagauccucuucaucgaggagggcaaggucauccacaucuccccccuccucggcuccgcccagcacgucgaggagugcuccugcuacccccgcuaccccgacguccgcugcaucugccgcgacaacuggaagggcuccaaccgccccaucgucgacauccgcaugaaggacuacuccaucggcuccuccuacaugugcuccggccucgucggcgacaccccccgcaacaacgacggcuccuccaacuccaacugccgcaaccccaacaacgagcgcggcaaccacggcgucaagggcugggccuucgacgacggcaacgacaucuggaugggccgcaccaucuccaaggacucccgccucggcuacgagaccuucaaggucgucggcggcuggucccagcccaacuccaaguuccagaucaaccgccaggucaucgucgacuccgacaaccgcuccggcuacuccggcaucuucuccgucgagggcaaguccugcaucaaccgcugcuucuacgucgagcucauccgcggccgccgccaggagacccgcgucugguggaccuccaacuccaucgucgucuucugcggcaccuccggcaccuacggcuccggcuccuggcccgacggcgccgacaucaacuucaugcccaucuga

SEQ ID NO: 117745 - RNA, 1353 nt, Artificial Sequence
  derived and/or modified sequence opt2 from neuraminidase_subtype_1__InfluenzaA__AAF74321
augaaccccaaccagaagaucaucaccaucggcuccaucugcauggucgucggcaucaucucccucaugcuccagaucggcaacaucaucuccgucugggucucccacaccauccagaccuggcaccccaaccagcccgagcccugcaaccaguccaucaacuucuacaccgagcaggccgccgccuccgucacccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacgagcaggccuccuacaagaucuucaagaucgagaagggccgcgucgucaaguccgucgagcucaacgcccccaacuaccacuaccaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacuccccccgccccaacgacggcaccggcuccugcggccccgucucccucaacggcgccuacggcgucaagggcuucuccuucaaguacggcaacggcgucuggaucggccgcaccaaguccaccuccucccgcuccggcuucgagaugaucugggaccccaacggcuggaccgagaccgacuccuccuucucccucaagcaggacaucaucgccaucaccgacugguccggcuacuccggcuccuucauccagcaccccgagcucaccggccucaacugcaugcgccccugcuucugggucgagcucauccgcggccgccccaaggagaagaccaucuggaccuccggcuccuccaucuccuucugcggcgucaacuccgacaccgucggcugguccuggcccgacggcgccgagcuccccuucaccaucgacaaguga

SEQ ID NO: 117746 - RNA, 1353 nt, Artificial Sequence
  derived and/or modified sequence opt2 from neuraminidase_subtype_1__InfluenzaA__AAF74322
augaaccccaaccagaagaucaucaccaucggcuccaucugcauggucgucggcaucaucucccucaugcuccagaucggcaacaccaucuccgucugggucucccacaucaucaagaccuggcaccccaaccagcccgagcccugcaaccaguccaucaacuucuacaccgagcaggccgccgccuccgucacccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacacccuccgcacccaggaguccgagugcgccugcgucaacggcuccugcuucaccgucaugaccgacggccccuccaacgagcaggccuccuacaagaucuucaagaucgagaagggccgcgucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacuccccccgccccaacgacggcaccggcuccugcggccccgucucccucaacggcgccuacggcgucaagggcuucuccuucaaguacggcaacggcgucuggaucggccgcaccaaguccaccuccucccgcuccggcuucgagaugaucugggaccccaacggcuggaccgagaccgacuccuccuucucccucaagcaggacaucaucgccaucaccgacugguccggcuacuccggcuccuucauccagcaccccgagcucaccggccucaacugcaugcgccccugcuucugggucgagcucauccgcggccgccccaaggagaagaccaucuggaccuccggcuccuccaucuccuucugcggcgucaacuccgacaccgucggcugguccuggcccgacggcgccgagcuccccuucaccaucgacaaguga

SEQ ID NO: 117747 - RNA, 1353 nt, Artificial Sequence
  derived and/or modified sequence opt2 from neuraminidase_subtype_1__InfluenzaA__AAF74323
augaaccccaaccagaagaucaucaccaucggcuccaucugcauggucgucggcaucaucucccucaugcuccagaucggcaacaucaucuccgucuggaucucccacaucauccagaccuggcaccccaaccagcccgagcccugcaaccaguccaucaacuucuacaccgagcaggccgccgccuccgucacccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaucuccuggcucaccaucggcaucuccggccccgacaacgaggccgucgccguccucaaguacaacggcaucaucaccgacaccauccgcuccuggcgcaacaacauccuccgcacccaggaguccgagugcgccugcgucaacggcuccugcuucaccgucaugaccgacggccccuccaacgagcaggccuccuacaagaucuucaagaucgagaagggccgcgucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacuccccccgccccaacgacggcaccggcuccugcggccccgucucccucaacggcgccuacggcgucaagggcuucuccuucaaguacggcaacggcgucuggaucggccgcaccaaguccaccuccucccgcuccggcuucgagaugaucugggaccccaacggcuggaccgagaccgacuccuccuucucccucaagcaggacaucaucgccgucaccgacugguccggcuacuccggcuccuucauccagcaccccgagcucaccggccucaacugcaugcgccccugcuucugggucgagcucauccgcggccgccccaaggagaagaccaucuggaccuccggcuccuccaucuccuucugcggcgucaacuccgacaccgucggcugguccuggcccgacggcgccgagcuccccuucaccaucgacaaguga

SEQ ID NO: 117748 - RNA, 1353 nt, Artificial Sequence
  derived and/or modified sequence opt2 from neuraminidase_subtype_1__InfluenzaA__AAF74324
augaaccccaaccagaagaucaucaccaucggcuccaucugcauggucgucggcaucaucucccucaugcuccagaucggcaacaucaucuccgucugggucucccacaucauccagaccuggcaccccaaccagcccgagcccugcaaccaguccaucaacuucuacaccgagcaggccgccgccuccgucacccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacgagcaggccuccuacaagaucuucaagaucgagaagggccgcgucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacuccccccgccccaacgacggcaccggcuccugcggccccgucucccucaacggcgccuacggcgucaagggcuucuccuucaaguacggcaacggcgucuggaucggccgcaccaaguccaccuccucccgcuccggcuucgagaugaucugggaccccaacggcuggaccgagaccgacuccuccuucucccucaagcaggacaucaucgccaucaccgacugguccggcuacuccggcuccuucauccagcaccccgagcucaccggccucaacugcaugcgccccugcuucugggucgagcucauccgcggccgccccaaggagaagaccaucuggaccuccggcuccuccgucuccuucugcggcgucaacuccgacaccaugggcugguccuggcccgacggcgccgagcuccccuucaccaucgacaaguga

SEQ ID NO: 117749 - RNA, 1353 nt, Artificial Sequence
  derived and/or modified sequence opt2 from neuraminidase_subtype_1__InfluenzaA__AAF74325
augaaccccaaccagaagaucaucaccaucggcuccaucugcauggucgucggcaucaucucccucaugcuccagaucggcaacaccaucuccgucugggucucccacaucaucaagaccuggcaccccaaccagcccgagcccugcaaccaguccaucaacuucuacaccgagcaggccgccgccuccgucacccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacacccuccgcacccaggaguccgagugcgccugcgucaacggcuccugcuucaccgucaugaccgacggccccuccaacgagcaggccuccuacaagaucuucaagaucgagaagggccgcgucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacuccccccgccccaacgacggcaccggcuccugcggccccgucucccucaacggcgccuacggcgucaagggcuucuccuucaaguacggcaacggcgucuggaucggccgcaccaaguccaccuccucccgcuccggcuucgagaugaucugggaccccaacggcuggaccgagaccgacuccuccuucucccucaagcaggacaucaucgccaucaccgacugguccggcuacuccggcuccuucauccagcaccccgagcucaccggccucaacugcaugcgccccugcuucugggucgagcucauccgcggccgccccaaggagaagaccaucuggaccuccggcuccuccaucuccuucugcggcgucaacuccgacaccgucggcugguccuggcccgacggcgccgagcuccccuacaccaucgacaaguga

SEQ ID NO: 117750 - RNA, 1410 nt, Artificial Sequence; identical to SEQ ID NO: 108240
  derived and/or modified sequence opt2 from neuraminidase__InfluenzaA__EPI239900

SEQ ID NO: 117751 - RNA, 1410 nt, Artificial Sequence; identical to SEQ ID NO: 108589
  derived and/or modified sequence opt2 from neuraminidase__InfluenzaA__EPI221062

SEQ ID NO: 117752 - RNA, 1410 nt, Artificial Sequence; identical to SEQ ID NO: 108240
  derived and/or modified sequence opt2 from neuraminidase__InfluenzaA__EPI534079

SEQ ID NO: 117753 - RNA, 1410 nt, Artificial Sequence; identical to SEQ ID NO: 108240
  derived and/or modified sequence opt2 from neuraminidase__InfluenzaA__AGM53851

SEQ ID NO: 117754 - RNA, 1410 nt, Artificial Sequence
  derived and/or modified sequence opt2 from neuraminidase__InfluenzaA__EPI731464
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcggcuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117755 - RNA, 1410 nt, Artificial Sequence; identical to SEQ ID NO: 108240
  derived and/or modified sequence opt2 from neuraminidase__InfluenzaA__EPI696973

SEQ ID NO: 117756 - RNA, 1410 nt, Artificial Sequence
  derived and/or modified sequence opt2 from neuraminidase__InfluenzaA__EPI662593
augaaccccaaccagaagaucaucaccaucggcuccaucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117757 - RNA, 1410 nt, Artificial Sequence; identical to SEQ ID NO: 117756
  derived and/or modified sequence opt2 from neuraminidase__InfluenzaA__EPI830229

SEQ ID NO: 117758 - RNA, 1410 nt, Artificial Sequence; identical to SEQ ID NO: 115349
  derived and/or modified sequence opt2 from neuraminidase__InfluenzaA__AGU92879

SEQ ID NO: 117759 - RNA, 1410 nt, Artificial Sequence; identical to SEQ ID NO: 115348
  derived and/or modified sequence opt2 from neuraminidase__InfluenzaA__AGU92857

SEQ ID NO: 117760 - RNA, 1410 nt, Artificial Sequence; identical to SEQ ID NO: 115347
  derived and/or modified sequence opt2 from neuraminidase__InfluenzaA__AGU92846

SEQ ID NO: 117761 - RNA, 1410 nt, Artificial Sequence; identical to SEQ ID NO: 115358
  derived and/or modified sequence opt2 from neuraminidase__InfluenzaA__AGU92835

SEQ ID NO: 117762 - RNA, 1410 nt, Artificial Sequence; identical to SEQ ID NO: 115334
  derived and/or modified sequence opt2 from neuraminidase__InfluenzaA__AGU92703

SEQ ID NO: 117763 - RNA, 1410 nt, Artificial Sequence
  derived and/or modified sequence opt2 from neuraminidase__InfluenzaA__EPI643117
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcaucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaccaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117764 - RNA, 1410 nt, Artificial Sequence
  derived and/or modified sequence opt2 from neuraminidase__InfluenzaA__EPI675797
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaagguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcaucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaccaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117765 - RNA, 1410 nt, Artificial Sequence; identical to SEQ ID NO: 117763
  derived and/or modified sequence opt2 from neuraminidase__InfluenzaA__EPI578429

SEQ ID NO: 117766 - RNA, 1410 nt, Artificial Sequence; identical to SEQ ID NO: 117763
  derived and/or modified sequence opt2 from neuraminidase__InfluenzaA__EPI614405

SEQ ID NO: 117767 - RNA, 1350 nt, Artificial Sequence; identical to SEQ ID NO: 117685
  derived and/or modified sequence opt2 from neuraminidase__InfluenzaA__AAT73329

SEQ ID NO: 117768 - RNA, 1350 nt, Artificial Sequence; identical to SEQ ID NO: 117685
  derived and/or modified sequence opt2 from neuraminidase__InfluenzaA__AAW80723

SEQ ID NO: 117769 - RNA, 1350 nt, Artificial Sequence; identical to SEQ ID NO: 117685
  derived and/or modified sequence opt2 from neuraminidase__InfluenzaA__EF541467

SEQ ID NO: 117770 - RNA, 1398 nt, Artificial Sequence; identical to SEQ ID NO: 114966
  derived and/or modified sequence opt2 from neuraminidase__InfluenzaA__EPI439509

SEQ ID NO: 117771 - RNA, 1410 nt, Artificial Sequence
  derived and/or modified sequence opt2 from neuraminidase__InfluenzaA__EPI482776
augaacaccaaccagcgcaucaucaccaucggcaccgucugcaugaucgucggcaucaucucccuccuccuccagaucggcaacaucgucucccucuggaucucccacuccauccagaccggcugggagaaccacaccgucaugugcaaccaguccgucaucaccuacgucaacaacaccugggucaaccgcaccuacgucaacaucuccaacaucaagaucgccaccauccaggacgucaccuccaucauccucgccggcaacuccucccucugccccgucuccggcugggccgucuacuccaaggacaacuccauccgcaucggcuccaagggcgacaucuucgucauccgcgagcccuucaucuccugcucccagcucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaaggucgagaagggcaagaucaucaaguccaucgagcucgacgcccccaacuaccacuacgaggagugcuccugcuaccccgacaccggcaaggucaugugcgucugccgcgacaacuggcacgccuccaaccgccccugggucuccuucaaccagaaccucgacuaccagaucggcuacaucugcuccggcgucuucggcgacaacccccgcuccaacgacggcaagggcaacugcggccccguccucuccaacggcgccaacggcgucaagggcuucuccuaccgcuacggcaacggcgucuggaucggccgcaccaaguccaucaacucccgcuccggcuucgagaugaucugggaccccaacggcuggaccgagaccgacuccuccuucuccaugaagcaggacaucaucgcccucaacgacugguccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucaacuccgagaccgccuccugguccuggcccgacggcgccgaccuccccuucaccaucgacaaguga

SEQ ID NO: 117772 - RNA, 1410 nt, Artificial Sequence
  derived and/or modified sequence opt2 from neuraminidase__InfluenzaA__EPI745533
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcaucaagcccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117773 - RNA, 1410 nt, Artificial Sequence; identical to SEQ ID NO: 108240
  derived and/or modified sequence opt2 from neuraminidase__InfluenzaA__AEE69012

SEQ ID NO: 117774 - RNA, 1410 nt, Artificial Sequence; identical to SEQ ID NO: 108240
  derived and/or modified sequence opt2 from neuraminidase__InfluenzaA__EPI176609

SEQ ID NO: 117775 - RNA, 1410 nt, Artificial Sequence; identical to SEQ ID NO: 108240
  derived and/or modified sequence opt2 from neuraminidase__InfluenzaA__EPI176472

SEQ ID NO: 117776 - RNA, 1410 nt, Artificial Sequence
  derived and/or modified sequence opt2 from neuraminidase__InfluenzaA__EPI280340
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaucaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 117777 - RNA, 1410 nt, Artificial Sequence; identical to SEQ ID NO: 108240
  derived and/or modified sequence opt2 from neuraminidase__InfluenzaA__EPI240318

SEQ ID NO: 117778 - RNA, 1410 nt, Artificial Sequence; identical to SEQ ID NO: 108240
  derived and/or modified sequence opt2 from neuraminidase__InfluenzaA__EPI183133

SEQ ID NO: 117779 - RNA, 1410 nt, Artificial Sequence; identical to SEQ ID NO: 108240
  derived and/or modified sequence opt2 from neuraminidase__InfluenzaA__EPI369141

SEQ ID NO: 117780 - RNA, 1410 nt, Artificial Sequence
  derived and/or modified sequence opt2 from neuraminidase__InfluenzaA__EPI482787
augaacaccaaccagcgcaucaucaccaucggcaccgucugccucaucgucggcaucgucucccuccuccuccagaucggcaacaucgucucccucuggaucucccacuccauccagaccggcaagcgcucccaccccgagaccugcucccagaacgucaucaccuacgagaacaacaccugggucaaccagaccuacgucaacaucuccaacaccaacaucgucgacggccagggcgucaccuccaucauccucgccggcaacuccccccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggagugcuccugcuaccccgacaccggcaaggucgucugcgucugccgcgacaacuggcacgccuccaaccgccccugggucaccuucgaccagaaccucaacuaccagaucggcuacaucugcuccggcgucuucggcgacaacccccgcuccaacgacggcaagggcaacugcggccccguccccuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaucaagcaggacaucaucgcccucaccgacugguccggcuacuccggcuccuucguccagcaccccgagcucaccggcaugaacugcaucaagcccugcuucugggucgagcucauccgcggccagcccaaggaguccaccaucuggaccuccggcuccuccaucuccuucugcggcgucgacuccgagaccgucuccugguccuggcccgacggcgccgaccuccccuucaccaucgacaaguga

SEQ ID NO: 117781 - RNA, 1410 nt, Artificial Sequence
  derived and/or modified sequence opt2 from neuraminidase__InfluenzaA__EPI482790
augaacaccaaccagcgcaucaucaccaucggcaccgucugccucaucgucggcaucaucucccuccuccuccagaucggcaacauggucucccucuggaucucccacuccauccagaccggcggcaagaaccacaccgagaugugcaaccagaacgucaucaccuacgucaacaacaccugggucaaccgcaccuacgucaacaucuccaacaccaagaucgucaacguccaggacgucgucuccgucauccucaccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaagauggagaagggcaagaucaucaaguccaucgagcucgacgcccccaacuaccacuacgaggagugcuccugcuaccccgacgccggcaaggucaugugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccacuccaacggcgccaacggcgucaagggcuucuccuaccgcuacggcaacggcgucuggaucggccgcaccaaguccaucaacucccgcuccggcuucgagaugaucugggaccccaacggcuggaccggcaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggagaacaccaucugggccuccggcuccuccaucuccuucugcggcgucaacggcgagaccgccuccugguccuggcccgacggcgccgaccuccccuucaccaucgacaaguga

SEQ ID NO: 117782 - RNA, 1410 nt, Artificial Sequence
  derived and/or modified sequence opt2 from neuraminidase__InfluenzaA__EPI291797
augaacaccaaccagcgcaucaucaccaucggcaccgucugcaugaucgucggcaucaucucccuccuccuccagaucggcaacaucgucucccucuggaucucccacuccauccagaccggcugggagaaccacaccgagaugugcaaccaguccgucaucaccuacgucaacaacaccugggucaaccgcaccuacgucaacaucuccaacaccaacaucgccaccauccaggacgucaccuccaucauccucgccggcaacuccucccucugccccgucuccggcugggccaucuacuccaaggacaacuccauccgcaucggcuccaagggcgacaucuucgucauccgcgagcccuucaucuccugcucccagcucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaaggucgagaagggcaagaucaucaaguccaucgagcucgacgcccccaacuaccacuacgaggagugcuccugcuaccccgacaccggcaaggucaugugcgucugccgcgacaacuggcacgccuccaaccgccccugggucuccuucaaccagaaccucgacuaccagaucggcuacaucugcuccggcgucuucggcgacaacccccgcuccaacgacggcaagggcaacugcggccccguccucuccaacggcgccaacggcgucaagggcuucuccuaccgcuacggcaacggcgucuggaucggccgcaccaaguccaucaacucccgcuccggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucaacuccgagaccgccuccugguccuggcccgacggcgccgaccuccccuucaccaucgacaaguga

SEQ ID NO: 117783 - RNA, 1410 nt, Artificial Sequence; identical to SEQ ID NO: 117782
  derived and/or modified sequence opt2 from neuraminidase__InfluenzaA__EPI482798

SEQ ID NO: 117784 - RNA, 1410 nt, Artificial Sequence
  derived and/or modified sequence opt2 from neuraminidase__InfluenzaA__EPI638969
augaacaccaaccagcgcaucaucaccaucggcaccgucugcaugaucgucggcaugaucucccuccuccuccagaucggcuccaucgucucccucuggaucucccacuccauccagaccggcugggagaaccacaccggcgucugcaaccaguccgucaucaccuacgucaacaacaccugggucaaccgcaccuacgucaacaucuccaacaucaagaucgccaccauccaggacgucacccccaucauccucgccggcaacuccucccucugccccgucaacggcugggccgucuacuccaaggacaacuccauccgcaucggcuccaagggcgacaucuucgucauccgcgagcccuucaucuccugcucccagcucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaaggucgagaagggcaagaucaucaaguccaucgagcucgacgcccccaacuaccacuacgaggagugcuccugcuaccccgacaccggcaaggucaugugcgucugccgcgacaacuggcacgccuccaaccgccccugggucuccuucaaccagaaccucgacuaccagaucggcuacaucugcuccggcgucuucggcgacaacccccgcuccaccgacggcaagggcaacugcggccccguccucuccaacggcgccaacggcgucaagggcuucuccuaccgcuacggcaacggcgucuggaucggccgcaccaaguccaucaacucccgcuccggcuucgagaugaucugggaccccaacggcuggaccgagaccgacuccuccuucuccaugaagcaggacaucaucgcccucaacgacuacuccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucaacuccgagaccgccuccugguccuggcccgacggcgccgaccuccccuucgccaucgacaaguga

SEQ ID NO: 117785 - RNA, 1410 nt, Artificial Sequence
  derived and/or modified sequence opt2 from neuraminidase__InfluenzaA__ABI19012
augaacaccaaccagcgcaucaucaccaucggcaccgucugccucaucgucggcaucaucucccuccuccuccagaucggcaacauggucucccucuggaucucccacuccauccagaccggcggcaagaaccacaccgagaugugcaaccagaacgucaucaccuacgucaacaacaccugggucaaccgcaccuacgucaacaucuccaacaccaagaucgucaacguccaggacgucgucuccgucauccucaccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaagauggagaagggcaagaucaucaaguccaucgagcucgacgcccccaacuaccacuacgaggagugcuccugcuaccccgacgccggcaaggucaugugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccacuccaacggcgccaacggcgucaagggcuucuccuaccgcuacggcaacggcgucuggaucggccgcaccaaguccaucaacucccgcuccggcuucgagaugaucugggaccccaacggcuggaccggcaccgacuccuccuucuccaugaagcaggacaucaucgcccucaccgacugguccggcuacuccggcuccuucguccgccaccccgagcucaccggcaugaacugcauccgccccugcuucugggucgagcucauccgcggccagcccaaggagaacaccaucugggccuccggcuccuccaucuccuucugcggcgucaacggcgagaccgccuccugguccuggcccgacggcgccgaccuccccuucaccaucgacaaguga

SEQ ID NO: 117786 - RNA, 1410 nt, Artificial Sequence
  derived and/or modified sequence opt2 from neuraminidase__InfluenzaA__EPI687791
augaaccccaaccagaagaucaucaccaucggcuccaucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgcccgccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117787 - RNA, 1410 nt, Artificial Sequence
  derived and/or modified sequence opt2 from neuraminidase__InfluenzaA__EPI841266
augaaccccaaccagaagaucaucaccaucggcuccaucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgcccgccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgaggagggcaagaucaucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117788 - RNA, 1410 nt, Artificial Sequence
  derived and/or modified sequence opt2 from neuraminidase__InfluenzaA__EPI291844
augaacaccaaccagcgcaucaucaccaucggcaccgucugccucaucgucggcaucaucucccuccuccuccagaucggcaccauggucucccucuggaucucccacuccauccagaccggcggcaagaaccacaccgagaugugcaaccagaacgucaucaccuacgucaacaacaccugggucaaccgcaccuacgucaacaucuccaacaccaagaucgucaacguccaggacgucgucuccgucauccucaccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaagauggagaagggcaagaucaucaaguccaucgagcucgacgcccccaacuaccacuacgaggagugcuccugcuaccccgacgccggcaaggucaugugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccacuccaacggcgccaacggcgucaagggcuucuccuacaaguacggcaacggcgucuggaucggccgcaccaaguccaucaacucccgcuccggcuucgagaugaucugggaccccaacggcuggaccggcaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggagaacaccaucugggccuccggcuccuccaucuccuucugcggcgucaacggcgagaccgccuccugguccuggcccgacggcgccgaccuccccuucaccaucgacaaguga

SEQ ID NO: 117789 - RNA, 1410 nt, Artificial Sequence
  derived and/or modified sequence opt2 from neuraminidase__InfluenzaA__EPI558120
augaacaccaaccagcgcaucaucaccaucggcaccgucugcaugaucgucggcaucaucucccuccuccuccagaucggcaacaucgucucccucuggaucucccacuccauccagaccggcugggagaaccacaccgagaugugcaaccaguccgucaucaccuacgucaacaacaccuggaugaaccgcaccuacgucaacaucuccaacaucaagaucgccaccauccaggacgucaccuccaucguccucgccggcaacuccucccucugccccgucuccggcugggccgucuacuccaaggacaacuccauccgcaucggcuccaagggcgacaucuucgucauccgcgagcccuucaucuccugcucccagcucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccguccucaccgacggccccuccaacggccaggccuccuacaagaucuucaaggucgagaagggcaagaucaucaaguccaucgagcucgacgcccccaacuaccacuacgaggagugcuccugcuaccccgacaccggcaaggucaugugcaucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuaccgcuacggcaacggcgucuggaucggccgcaccaaguccaucaacucccgcuccggcuucgagaugaucugggaccccaacggcuggaccgagaccgacuccuccuucuccaugaagcaggacaucaucgcccucaacgacugguccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucaacuccgagaccgccuccugguccuggcccgacggcgccgaccuccccuucaccaucgacaaguga

SEQ ID NO: 117790 - RNA, 1410 nt, Artificial Sequence
  derived and/or modified sequence opt2 from neuraminidase__InfluenzaA__EPI564138
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucgucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117791 - RNA, 1410 nt, Artificial Sequence
  derived and/or modified sequence opt2 from neuraminidase__InfluenzaA__ANM92825
augaaccccaaccagaagaucaucaccaucggcuccaucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcgucuucggcgacaacccccgccccaacgacaagaccggcaacugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117792 - RNA, 1410 nt, Artificial Sequence
  derived and/or modified sequence opt2 from neuraminidase__InfluenzaA__EPI291694
augaacaccaaccagcgcaucaucaccaucggcaccgucugccucaucgucggcaucgucucccuccuccuccagaucggcaacaucgucucccucuggaucucccacuccauccagaccggcgagaagaaccacuccgaggucugcaaccagaacaucaucaccuacgagaacaagaccugggucaaccagaccuacgucaacaucuccaacaccaacaucgccgagggccagggcgucaccuccaucauccucgccggcaacuccucccucugccccgucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccucaccggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccccuccaacggcgccaacggcgucaagggcuucuccuuccgcuacggcaacggcgucuggaucggccgcaccaaguccaucaucucccgcuccggcuucgagaugaucugggaccccaacggcuggaccgagaccgacuccuccuucuccaucaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucgacuccgagaccgccuccugguccuggcccgacggcgccgaccuccccuucaccaucgacaaguga

SEQ ID NO: 117793 - RNA, 1410 nt, Artificial Sequence; identical to SEQ ID NO: 108726
  derived and/or modified sequence opt2 from neuraminidase__InfluenzaA__EPI241027

SEQ ID NO: 117794 - RNA, 1410 nt, Artificial Sequence; identical to SEQ ID NO: 108250
  derived and/or modified sequence opt2 from neuraminidase__InfluenzaA__EPI177405

SEQ ID NO: 117795 - RNA, 1410 nt, Artificial Sequence; identical to SEQ ID NO: 108250
  derived and/or modified sequence opt2 from neuraminidase__InfluenzaA__EPI242475

SEQ ID NO: 117796 - RNA, 1410 nt, Artificial Sequence
  derived and/or modified sequence opt2 from neuraminidase__InfluenzaA__EPI590131
augaacgccaaccagcgcaucaucaccaucggcaccgucugccucaucaucggcaucaucucccuccuccuccagaucggcaacauggucucccucuggaucucccacuccauccagaccggcggcaagaaccacaccgagaugugcaaccagaacgucaucaccuacgucaacaacaccugggucaaccgcaccuacgucaacaucuccaacaccaagaucgucaacguccaggacgucgucuccgucauccucaccggcaacuccucccucugcuccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaucggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucgccguccucaccgacggccccuccaacggccaggccuccuacaagaucuucaaggucaagcagggcaagaucaucaaguccaucgagcucgacgcccccaacuaccacuacgaggagugcuccugcuaccccgacgccggcaaggucaugugcgucugccgcgacaacuggcacgccuccaaccgccccugggucuccuucgaccaggaccucaacuaccagaucggcuacaucugcuccggcgucuucggcgacaacccccgcuccaacgacggcaagggcaacugcggccccguccacuccaacggcgccaacggcgucaagggcuucuccuaccgcuacggcaacggcgucuggaucggccgcaccaaguccauccacucccgcuccggcuucgagaugaucugggaccccaacggcuggaccggcaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggagaacaccaucugggccuccggcuccuccaucuccuucugcggcgucaacggcgagaccgccuccugguccuggcccgacggcgccgaccuccccuucaccaucgacaaguga

SEQ ID NO: 117797 - RNA, 1410 nt, Artificial Sequence
  derived and/or modified sequence opt2 from neuraminidase__InfluenzaA__EPI68596
augaacaccaaccagcgcaucaucaccaucggcaccgucugccucaucgucggcaucgucucccuccuccuccagaucggcaacaucgucucccucuggaucucccacuccauccagaccggcgagaagaaccacuccgagaucugcucccagaacgucaucaccuacgagaacaacaccugggucaaccagaccuacgucaacaucuccaacaccaacaucgccgacggccagggcgucaccuccaucauccucgccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaucaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucgacuccgagaccgccuccugguccuggcccgacggcgccgaccuccccuucaccaucgacaaguga

SEQ ID NO: 117798 - RNA, 1365 nt, Artificial Sequence; identical to SEQ ID NO: 107231
  derived and/or modified sequence opt2 from neuraminidase__InfluenzaA__EPI115409

SEQ ID NO: 117799 - RNA, 1365 nt, Artificial Sequence; identical to SEQ ID NO: 107231
  derived and/or modified sequence opt2 from neuraminidase__InfluenzaA__ABD77678/m1

SEQ ID NO: 117800 - RNA, 1410 nt, Artificial Sequence; identical to SEQ ID NO: 108240
  derived and/or modified sequence opt2 from neuraminidase__InfluenzaA__EPI185224

SEQ ID NO: 117801 - RNA, 1410 nt, Artificial Sequence; identical to SEQ ID NO: 117756
  derived and/or modified sequence opt2 from neuraminidase__InfluenzaA__EPI697745

SEQ ID NO: 117802 - RNA, 1410 nt, Artificial Sequence; identical to SEQ ID NO: 117756
  derived and/or modified sequence opt2 from neuraminidase__InfluenzaA__EPI768524

SEQ ID NO: 117803 - RNA, 1410 nt, Artificial Sequence
  derived and/or modified sequence opt2 from neuraminidase__InfluenzaA__EPI726929
augaaccccaaccagaagaucaucaccaucggcuccaucuccaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117804 - RNA, 1410 nt, Artificial Sequence; identical to SEQ ID NO: 117803
  derived and/or modified sequence opt2 from neuraminidase__InfluenzaA__EPI813816

SEQ ID NO: 117805 - RNA, 1410 nt, Artificial Sequence
  derived and/or modified sequence opt2 from neuraminidase__InfluenzaA__EPI466627
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117806 - RNA, 1410 nt, Artificial Sequence
  derived and/or modified sequence opt2 from neuraminidase__InfluenzaA__EPI541965
augaaccccaaccagaagaucaucaccaucggcuccgucugcaugaccaucggcauggccaaccucauccuccagaucggcaacaucaucuccaucugggucucccacuccauccagcucggcaaccagucccagaucgagaccugcaaccaguccgucaucaccuacgagaacaacaccugggucaaccagaccuacgucaacaucuccaacaccaacuucgccgccggccagcccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucgcccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117807 - RNA, 1410 nt, Artificial Sequence
  derived and/or modified sequence opt2 from neuraminidase__InfluenzaA__EPI652004
augaaccccaaccagaagaucaucaccaucggcuccgucugcaugaccaucggcauggccaaccucauccuccagaucggcaacaucaucuccaucugggucucccacuccauccagaucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucgcccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 117808 - RNA, 1410 nt, Artificial Sequence
  derived and/or modified sequence opt2 from neuraminidase__InfluenzaA__EPI62526
augaacaccaaccagcgcaucaucaccaucggcaccgucugccucaucgucggcaucgucucccuccuccuccagaucggcaacaucgucucccucuggaucucccacuccauccagaccggcgagaagaaccaccccgagaucugcucccagaacgucaucaccuacgagaacaacaccugggucaaccagaccuacgucaacaucuccaacaccaacaucgucgacggccagggcgucaccuccaucauccucgccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaucaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucgacuccgagaccgccuccugguccuggcccgacggcgccgaccuccccuucaccaucgacaaguga

SEQ ID NO: 117809 - RNA, 1410 nt, Artificial Sequence; identical to SEQ ID NO: 108240
  derived and/or modified sequence opt2 from neuraminidase__InfluenzaA__EPI189183

SEQ ID NO: 117810 - RNA, 1410 nt, Artificial Sequence; identical to SEQ ID NO: 108240
  derived and/or modified sequence opt2 from neuraminidase__InfluenzaA__EPI180576

SEQ ID NO: 117811 - RNA, 1410 nt, Artificial Sequence
  derived and/or modified sequence opt2 from neuraminidase__InfluenzaA__EPI346918
augaacaccaaccagcgcaucaucaccaucggcaccgucugcaugaucgucggcaucaucucccuccuccuccagaucggcaacaucgucucccucuggaucucccacuccauccagaccggcugggagaaccacaccgagaugugcaaccagaacgucaucaccuacgucaacaacaccugggucaaccgcaccuacgucaacgucuccaacaccaacaucgccaccauccaggacgucaccuccaucguccucgccggcaacuccucccucugccccgucuccggcugggccaucuacuccaaggacaacuccauccgcaucggcuccaagggcgacaucuucgucauccgcgagcccuucaucuccugcucccagcucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaaggucgagaagggccgcaucaucaaguccaucgagcucgacgcccccaacuaccacuacgaggagugcuccugcuaccccgacaccggcaaggucaugugcgucugccgcgacaacuggcacgccuccaaccgccccugggucuccuucaaccagaaccucgacuaccagaucggcuacaucugcuccggcgucuucggcgacaacccccgcuccaacgacggcaagggcaacugcggccccguccucuccaacggcgccaacggcgucaagggcuucuccuaccgcuacggcaacggcgucuggaucggccgcaccaaguccaucaacucccgccgcggcuucgagaucaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucaacuccgagaccgccuccugguccuggcccgacggcgccgaccuccccuucaccaucgacaaguga

SEQ ID NO: 117812 - RNA, 1410 nt, Artificial Sequence; identical to SEQ ID NO: 108828
  derived and/or modified sequence opt2 from neuraminidase__InfluenzaA__EPI240976

SEQ ID NO: 117813 - RNA, 1410 nt, Artificial Sequence; identical to SEQ ID NO: 105607
  derived and/or modified sequence opt2 from neuraminidase__InfluenzaA__EPI3165

SEQ ID NO: 117814 - RNA, 1410 nt, Artificial Sequence; identical to SEQ ID NO: 117533
  derived and/or modified sequence opt2 from neuraminidase__InfluenzaA__EPI957

SEQ ID NO: 117815 - RNA, 1410 nt, Artificial Sequence; identical to SEQ ID NO: 113658
  derived and/or modified sequence opt2 from neuraminidase__InfluenzaA__EPI507593

SEQ ID NO: 117816 - RNA, 1410 nt, Artificial Sequence; identical to SEQ ID NO: 113658
  derived and/or modified sequence opt2 from neuraminidase__InfluenzaA__EPI461954

SEQ ID NO: 117817 - RNA, 1410 nt, Artificial Sequence; identical to SEQ ID NO: 113658
  derived and/or modified sequence opt2 from neuraminidase__InfluenzaA__EPI461954

SEQ ID NO: 117818 - RNA, 1410 nt, Artificial Sequence
  derived and/or modified sequence opt2 from neuraminidase__InfluenzaA__EPI668104
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuucuaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcaacgccuccggcaaggccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucgucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117819 - RNA, 1410 nt, Artificial Sequence
  derived and/or modified sequence opt2 from neuraminidase__InfluenzaA__EPI578445
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcaacgccuccggcaaggccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucgucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117820 - RNA, 1410 nt, Artificial Sequence; identical to SEQ ID NO: 117819
  derived and/or modified sequence opt2 from neuraminidase__InfluenzaA__EPI551883

SEQ ID NO: 117821 - RNA, 1410 nt, Artificial Sequence
  derived and/or modified sequence opt2 from neuraminidase__InfluenzaA__EPI344388
augaaccccaaccagaagaucaucaccaucggcuccgucucccucaucaucgccaccaucugcuuccucaugcagaucgccauccucgucaccaccgucacccuccacuucaagcagcacgacuacaacuccccccccaacaaccaggccaugcucugcgagcccaccaucaucgagcgcaacaccaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccacgaccgcacccccuaccgcacccuccucaugaacgagcucggcguccccuuccaccucggcacccgccaggucugcauggccugguccuccuccuccugccacgacggcaaggccuggcuccacgucugcaucaccggcaacgacaacaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucgucgaggagggcaagaucguccacaucuccacccucuccggcuccgcccagcacgucgaggagugcuccugcuacccccgcuuccccggcguccgcugcgucugccgcgacaacuggaagggcuccaaccgccccaucgucgacaucaacgucaagaacuacuccaucgucuccuccuacgucugcuccggccucgucggcgacaccccccgcaaguccgacuccgucuccuccuccuacugccucgaccccaacaacgagaagggcggccacggcgucaagggcugggccuucgacgacggcaacgacgucuggaugggccgcaccaucaacgagacccuccgccucggcuacgagaccuucaaggucaucgagggcugguccaaggccaacuccaagcuccagaccaaccgccaggucaucgucgagaagggcgaccgcuccggcuacuccggcaucuucuccgucgagggcaaguccugcaucaaccgcugcuucuacgucgagcucauccgcggccgcaaggaggagaccaaggucugguggaccuccaacuccaucgucgucuucugcggcaccuccggcaccuacggcaccggcuccuggcccgacggcgccgacaucaaccucaugcccaucuga

SEQ ID NO: 117822 - RNA, 1410 nt, Artificial Sequence; identical to SEQ ID NO: 117821
  derived and/or modified sequence opt2 from neuraminidase__InfluenzaA__EPI347601

SEQ ID NO: 117823 - RNA, 1410 nt, Artificial Sequence
  derived and/or modified sequence opt2 from neuraminidase__InfluenzaA__EPI642512
augaaccccaaccagaagaucaucaccaucggcuccaucucccucaucaucgccaccaucugcuuccucaugcagaucgccauccucgucaucaccgucacccuccacuucaagcagcacaacugcgacuccucccccaacaaccaggucauguucugcgagcccaccaucaucgagcgcaacaagaccgagaucgucuaccucaucaacaccaccgucgagaaggagaucugccccaagcccaccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcaucaccggcgacgacggcaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagucccgccucggcuacgagaccuucaaggucgucaagggcugguccgagcccaacuccaagcuccagaccaaccgccaggucaucgucggccgcggcaaccgcuccggcuacuccggcaucuucuccaucgagggcaagaacugcaucaaccgcugcuucuacgucgagcucauccgcggccgcaaggaggagaccaaggucugguggaccuccaacuccaucgucgucuucugcggcaccuccggcaccuacggcaccggcuccuggcccgacggcgccgacaucaaccucaugcccaucuga

SEQ ID NO: 117824 - RNA, 1410 nt, Artificial Sequence
  derived and/or modified sequence opt2 from neuraminidase__InfluenzaA__AIE52540
augaaccccaaccagaagaucaucaccaucggcuccgucucccucaucaucgccaccaucugcuuccucaugcagaucgccauccucgucaccaccgucacccuccacuucaagcagcacgacuacaacuccccccccaacaaccaggucaugcucugcgagcccaccaucaucgagcgcaacaccaccgagaucgucuaccucaccaacaucaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacaacaccguccacgaccgcucccccuaccgcacccuccucaugaacgagcucggcguccccuuccaccucggcacccgccaggucugcaucgccugguccuccuccuccugccacgacggcaaggccuggcuccacgucugcaucaccggcgacgacaacaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacaugaaggacuacuccaucgccuccuccuacgucugcuccggccucgucggcgacaccccccgcaagaacgacuccuucuccuccucccacugccucgaccccaacaacgagaagggcggccacggcgucaagggcugggccuucgacgacggcaacgacgucuggaugggccgcaccaucuccgaggaguuccgccucggcuacgagaccuucaaggucaucaagggcugguccaaccccaacuccaagcuccagaccaaccgccaggucaucgucgagaagggcaaccgcuccggcuacuccggcgucuucuccaucgaggacaaguccugcaucaaccgcugcuucuacgucgagcucauccgcggccgcaaggaggagaccaaggucugguggaccuccaacuccaucgucgucuucugcggcaccuccggcaccuacggcaccggcuccuggcccgacggcgccgacaucaaccucaugcccaucuga

SEQ ID NO: 117825 - RNA, 1410 nt, Artificial Sequence; identical to SEQ ID NO: 117824
  derived and/or modified sequence opt2 from neuraminidase__InfluenzaA__EPI465399

SEQ ID NO: 117826 - RNA, 1410 nt, Artificial Sequence; identical to SEQ ID NO: 117824
  derived and/or modified sequence opt2 from neuraminidase__InfluenzaA__EPI328899

SEQ ID NO: 117827 - RNA, 1410 nt, Artificial Sequence; identical to SEQ ID NO: 117824
  derived and/or modified sequence opt2 from neuraminidase__InfluenzaA__EPI328901

SEQ ID NO: 117828 - RNA, 1410 nt, Artificial Sequence
  derived and/or modified sequence opt2 from neuraminidase__InfluenzaA__EPI574645
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 117829 - RNA, 1410 nt, Artificial Sequence
  derived and/or modified sequence opt2 from neuraminidase__InfluenzaA__EPI563214
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcuccaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucgucuacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucgucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117830 - RNA, 1410 nt, Artificial Sequence; identical to SEQ ID NO: 117829
  derived and/or modified sequence opt2 from neuraminidase__InfluenzaA__EPI553998

SEQ ID NO: 117831 - RNA, 1410 nt, Artificial Sequence
  derived and/or modified sequence opt2 from neuraminidase__InfluenzaA__EPI551568
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcuccaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucgucuacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucgucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117832 - RNA, 1410 nt, Artificial Sequence
  derived and/or modified sequence opt2 from neuraminidase__InfluenzaA__EPI629737
augaaccccaaccagaagaucaucgccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcuccaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucgucuacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucgucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117833 - RNA, 1410 nt, Artificial Sequence; identical to SEQ ID NO: 117829
  derived and/or modified sequence opt2 from neuraminidase__InfluenzaA__EPI631886

SEQ ID NO: 117834 - RNA, 1410 nt, Artificial Sequence; identical to SEQ ID NO: 117829
  derived and/or modified sequence opt2 from neuraminidase__InfluenzaA__EPI577025

SEQ ID NO: 117835 - RNA, 1410 nt, Artificial Sequence; identical to SEQ ID NO: 115383
  derived and/or modified sequence opt2 from neuraminidase__InfluenzaA__EPI404926

SEQ ID NO: 117836 - RNA, 1410 nt, Artificial Sequence; identical to SEQ ID NO: 115383
  derived and/or modified sequence opt2 from neuraminidase__InfluenzaA__EPI492687

SEQ ID NO: 117837 - RNA, 1410 nt, Artificial Sequence
  derived and/or modified sequence opt2 from neuraminidase__InfluenzaA__EPI530648
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaccaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117838 - RNA, 1410 nt, Artificial Sequence; identical to SEQ ID NO: 117819
  derived and/or modified sequence opt2 from neuraminidase__InfluenzaA__EPI684314

SEQ ID NO: 117839 - RNA, 1410 nt, Artificial Sequence
  derived and/or modified sequence opt2 from neuraminidase__InfluenzaA__EPI614459
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaccaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117840 - RNA, 1410 nt, Artificial Sequence; identical to SEQ ID NO: 117839
  derived and/or modified sequence opt2 from neuraminidase__InfluenzaA__EPI541466

SEQ ID NO: 117841 - RNA, 1410 nt, Artificial Sequence; identical to SEQ ID NO: 117839
  derived and/or modified sequence opt2 from neuraminidase__InfluenzaA__EPI696968

SEQ ID NO: 117842 - RNA, 1410 nt, Artificial Sequence; identical to SEQ ID NO: 117839
  derived and/or modified sequence opt2 from neuraminidase__InfluenzaA__EPI674598

SEQ ID NO: 117843 - RNA, 1410 nt, Artificial Sequence; identical to SEQ ID NO: 117837
  derived and/or modified sequence opt2 from neuraminidase__InfluenzaA__EPI530678

SEQ ID NO: 117844 - RNA, 1410 nt, Artificial Sequence
  derived and/or modified sequence opt2 from neuraminidase__InfluenzaA__EPI530680
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacggcgucuggaugggccgcaccaucaacgagaccucccgccucggcuacgagaccuucaaggucaucgagggcugguccaaccccaaguccaagcuccagaccaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117845 - RNA, 1410 nt, Artificial Sequence; identical to SEQ ID NO: 105550
  derived and/or modified sequence opt2 from neuraminidase__InfluenzaA__EPI7603

SEQ ID NO: 117846 - RNA, 1410 nt, Artificial Sequence; identical to SEQ ID NO: 117837
  derived and/or modified sequence opt2 from neuraminidase__InfluenzaA__EPI814527

SEQ ID NO: 117847 - RNA, 1410 nt, Artificial Sequence; identical to SEQ ID NO: 117837
  derived and/or modified sequence opt2 from neuraminidase__InfluenzaA__EPI674737

SEQ ID NO: 117848 - RNA, 1410 nt, Artificial Sequence; identical to SEQ ID NO: 117837
  derived and/or modified sequence opt2 from neuraminidase__InfluenzaA__EPI614443

SEQ ID NO: 117849 - RNA, 1410 nt, Artificial Sequence; identical to SEQ ID NO: 117837
  derived and/or modified sequence opt2 from neuraminidase__InfluenzaA__EPI551812

SEQ ID NO: 117850 - RNA, 1410 nt, Artificial Sequence; identical to SEQ ID NO: 117837
  derived and/or modified sequence opt2 from neuraminidase__InfluenzaA__EPI696961

SEQ ID NO: 117851 - RNA, 1410 nt, Artificial Sequence; identical to SEQ ID NO: 117837
  derived and/or modified sequence opt2 from neuraminidase__InfluenzaA__EPI740789

SEQ ID NO: 117852 - RNA, 1410 nt, Artificial Sequence
  derived and/or modified sequence opt2 from neuraminidase__InfluenzaA__EPI377498
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 117853 - RNA, 1410 nt, Artificial Sequence; identical to SEQ ID NO: 117852
  derived and/or modified sequence opt2 from neuraminidase__InfluenzaA__EPI377498

SEQ ID NO: 117854 - RNA, 1410 nt, Artificial Sequence; identical to SEQ ID NO: 117852
  derived and/or modified sequence opt2 from neuraminidase__InfluenzaA__EPI391246

SEQ ID NO: 117855 - RNA, 1410 nt, Artificial Sequence; identical to SEQ ID NO: 117852
  derived and/or modified sequence opt2 from neuraminidase__InfluenzaA__EPI407122

SEQ ID NO: 117856 - RNA, 1410 nt, Artificial Sequence; identical to SEQ ID NO: 117852
  derived and/or modified sequence opt2 from neuraminidase__InfluenzaA__EPI407125

SEQ ID NO: 117857 - RNA, 1410 nt, Artificial Sequence; identical to SEQ ID NO: 117819
  derived and/or modified sequence opt2 from neuraminidase__InfluenzaA__EPI562038

SEQ ID NO: 117858 - RNA, 1410 nt, Artificial Sequence; identical to SEQ ID NO: 117819
  derived and/or modified sequence opt2 from neuraminidase__InfluenzaA__EPI562038

SEQ ID NO: 117859 - RNA, 1410 nt, Artificial Sequence; identical to SEQ ID NO: 114129
  derived and/or modified sequence opt2 from neuraminidase__InfluenzaA__EU716525

SEQ ID NO: 117860 - RNA, 1350 nt, Artificial Sequence
  derived and/or modified sequence opt2 from neuraminidase__InfluenzaA__EPI232422
augaaccccaaccagaagaucaucaccaucggcuccaucugcauggucaucggcaucgucucccucaugcuccagaucggcaacaugaucuccaucugggucucccacuccauccagaccggcaaccagcgccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117861 - RNA, 1350 nt, Artificial Sequence; identical to SEQ ID NO: 117696
  derived and/or modified sequence opt2 from neuraminidase__InfluenzaA__EPI227593

SEQ ID NO: 117862 - RNA, 1350 nt, Artificial Sequence
  derived and/or modified sequence opt2 from neuraminidase__InfluenzaA__EPI435658
augaaccccaaccagaagaucgucaccaucggcuccaucugcauggucaucggcaucaucucccucaugcuccagaucggcaacaucaucuccaucugggucucccacuccauccagaccggcaaccagcaccagaccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccaucggcgaggcccccucccccuacaacucccgcuucgaguccgucgccugguccgccuccgccugccacgacggcaccuccuggcucaucaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaucgagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccacccacucccgcuccggcuucgagaugaucugggaccccaacggcuggaccggcaccgacuccgaguucuccaugaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117863 - RNA, 1350 nt, Artificial Sequence; identical to SEQ ID NO: 117862
  derived and/or modified sequence opt2 from neuraminidase__InfluenzaA__EPI492513

SEQ ID NO: 117864 - RNA, 1350 nt, Artificial Sequence; identical to SEQ ID NO: 111209
  derived and/or modified sequence opt2 from neuraminidase__InfluenzaA__EPI165066

SEQ ID NO: 117865 - RNA, 1350 nt, Artificial Sequence
  derived and/or modified sequence opt2 from neuraminidase__InfluenzaA__EPI531308
augaaccccaaccagaagaucaucaccaucggcuccaucugcauggucaccggcgucgucucccucaugcuccaggucggcaacaugaucuccaucuggaucucccacuccauccacaccggcaaccagcaccaggccgagcccaucuccaacaccaacuuccacaccgagaaggccgucgucuccgccaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacguccuccgcacccaggaguccgagugcgccugcgucaacggcuacugcuucaccgucaugaccgacggccccuccaacggccaggccucccacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccuggaucuccuucaaccagaaccucgaguaccagaucggcuacaucugcuccggcgucuucggcgacaacccccgccccaacgacggcaagggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggagggcaccaucuggaccuccggcuccuccaucuccuucugcggcgucuccggcgacaccgucggcugguccuggcccgacggcgccgagcuccccuucaccaucgacaaguga

SEQ ID NO: 117866 - RNA, 1350 nt, Artificial Sequence
  derived and/or modified sequence opt2 from neuraminidase__InfluenzaA__EPI433308
augaaccccaaccagaagaucaucaccaucggcuccaucugcauggucaucggcaucgucucccucaugcuccagaucggcaaccucaucuccaucugggucucccacuccauccagcgcggcaaccucaaccaggucgagcccaucuccaacaccuccuuccccaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggggcaacaacauccuccgcacccaggaguccgagugcgccugcgucaacggcuccugcuucaccgucaugaccgacggccccuccaacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacauccucgccgucaccgacugguccggcuacuccggcuccuucguccagcaccccgagcucaccggccucgacugcauccgccccugcuucugggucgagcucauccgcggccgccccgaggaguccaccaucuggaccuccggcuccuccaucuccuucugcggcgucaacuccgacaccgucuccugguccuggcccgacggcgccgagcuccccuucaccaucgacaaguga

SEQ ID NO: 117867 - RNA, 1350 nt, Artificial Sequence
  derived and/or modified sequence opt2 from neuraminidase__InfluenzaA__EPI114974
augaaccccaaccagaagaucaucaccaucggcuccaucugcauggucaucggcaucgucucccucaugcuccagaucggcaacaugaucuccaucugggucucccacuccauccagaccggcaaccagcgccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccaucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117868 - RNA, 1350 nt, Artificial Sequence
  derived and/or modified sequence opt2 from neuraminidase__InfluenzaA__EPI622495
augaaccccaaccagaagaucaccaccaucggcuccaucugcauggucaucggcaucgucucccucaugcuccagaucggcaacauggucuccaucugggucucccacuccauccagacccgcaaccagcgccaggccgagcccaucuccaacacccgcucccucaccgagaaggccgucgccuccgucacccucgccggcaacuccucccucugccccaucuccggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgucugcgucaacggcuccugcuucaccgucaugaccgacggccccuccaacaagcaggccuccuacaagaucuucaagauggagaagggcaaggucgucaaguccaucgagcucgacgcccccaacuaccacuacgaggagugcuccugcuaccccgacgccggcgagaucaccugcgucugccgcgacaacuggcacggcuccaaccgccccuggcucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccaugaagcaggacaucgucgccaucaccgacugguccggcuacuccggcuccuucguccagcaccccgagcucaccggccucgacugcauccgccccugcuucugggucgagcucguccgcggccgccccaaggagggcaccaucuggaccuccggcuccuccaucuccuucugcggcgucaacuccgacaccgucuccugguccuggcccgacggcgccgagcuccccuucaccaucgacaaguga

SEQ ID NO: 117869 - RNA, 1350 nt, Artificial Sequence
  derived and/or modified sequence opt2 from neuraminidase__InfluenzaA__EPI349847
augaaccccaaccagaagaucaccaccaucggcuccaucugcauggucaucggcaucgucucccucaugcuccagaucggcaacauggucuccaucugggucucccacuccauccagacccgcaaccagcgccaggccgagcccaucuccaacacccgcucccucaccgagaaggccgucgccuccgucacccucgccggcaacuccucccucugccccaucuccggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgucugcgucaacggcuccugcuucaccgucaugaccgacggccccuccaacaagcaggccuccuacaagaucuucaagauggagaagggcaaggucgucaaguccaucgagcucgacgcccccaacuaccacuacgaggagugcuccugcuaccccgacgccggcgagaucaccugcgucugccgcgacaacuggcacggcuccaaccgccccuggcucuccuucaaccagaaccucgaguaccagaucggcuacaucugcuccggcgucuucggcgacaacccccgccccaacgacggcaccggcuccugcggccccgucucccacaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccaugaagcaggacaucgucgccaucaccgacugguccggcuacuccggcuccuucguccagcaccccgagcucaccggccucgacugcauccgccccugcuucugggucgagcucguccgcggccgccccaaggagggcaccaucuggaccuccggcuccuccaucuccuucugcggcgucaacuccgacaccgucuccugguccuggcccgacggcgccgagcuccccuucaccaucgacaaguga

SEQ ID NO: 117870 - RNA, 1350 nt, Artificial Sequence
  derived and/or modified sequence opt2 from neuraminidase__InfluenzaA__EPI174804
augaaccccaaccagaagaucaucaccaucggcuccaucugcauggucaucggcaucgucucccucaugcuccagaucggcaacauggucuccaucugggucucccacuccauccagacccgcaaccagcgccaggccgagcccaucuccaacaccaagucccucaccgagaaggccgucgccuccgucacccucgccggcaacuccucccucugccccaucuccggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucgccgucaugaccgacggccccuccaaccgccaggccuccuacaagaucuucaagauggagaagggcaaggucgucaaguccaucgagcucgacgcccccaacuaccacuacgaggagugcuccugcuaccccgacgccggcgagaucaccugcgucugccgcgacaacuggcacggcuccaaccgccccuggcucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccaugaagcaggacaucgucgccaucaccgacugguccggcuacuccggcuccuucguccagcaccccgagcucaccggccucgacugcauccgccccugcuucugggucgagcucguccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117871 - RNA, 1350 nt, Artificial Sequence
  derived and/or modified sequence opt2 from neuraminidase__InfluenzaA__EPI492441
augaaccccaaccagaagaucauggccaucggcuccgucugcauggucaucggcaucgucucccucaugcuccagaucggcaacaccaucuccaucugggucucccacuccuuccagacccgcguccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaaccgcaccgucaaggaccgcuccccccaccgcacccucauguccugccccgucggcgagguccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuucugcuucaccgucaugaccgacggccccuccaacggccaggccuccuacaagaucuucaagaugaagaagggcaaggucgucaaguccgucgagcucaacgcccccaacuaccacuacgaggagugcuccugcuaccccgacgccggcgagaucaugugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagauggucugggaccccaacggcuggaccgacaccgacuccgacuucuccaucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgagaccgucuccugguccuggcccgacggcgccgagcuccccuucaccaucgacaaguga

SEQ ID NO: 117872 - RNA, 1350 nt, Artificial Sequence; identical to SEQ ID NO: 117499
  derived and/or modified sequence opt2 from neuraminidase__InfluenzaA__EPI164142

SEQ ID NO: 117873 - RNA, 1350 nt, Artificial Sequence
  derived and/or modified sequence opt2 from neuraminidase__InfluenzaA__EPI827076
augaaccccaaccagaagaucgucaccaucggcuccaucugcauggucaucggcaucaucucccucaugcuccagaucggcaacaucaucuccaucugggucucccacuccauccagaccggcaaccagcaccagaccgagcccauccgcaacaccaacuuccucaccgagaacgccgucgccuccgucacccucgccggcaacuccucccucugccccaucaagggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccaucggcgaggcccccucccccuacaacucccgcuucgaguccgucgccugguccgccuccgccugccacgacggcaccuccuggcucaucaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucgccgucaugaccgacggccccuccaacggccaggccuccuacaagaucuucaagaucgagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccacccacucccgcuccggcuucgagaugaucugggaccccaacggcuggaccggcaccgacuccgaguucuccaugaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117874 - RNA, 1350 nt, Artificial Sequence; identical to SEQ ID NO: 108091
  derived and/or modified sequence opt2 from neuraminidase__InfluenzaA__EPI168491

SEQ ID NO: 117875 - RNA, 1350 nt, Artificial Sequence
  derived and/or modified sequence opt2 from neuraminidase__InfluenzaA__EPI827078
augaaccccaaccagaagaucaucaccaucggcuccaucugcauggucaucggcaucgccucccucaugcuccagaucggcaacaucaucuccaucuggaucucccacuccauccagaccggcaaccagugccagaacgaguccaucuccaacaccaaguuccucgccgagaaggccgucgccuccgucacccucgccggcaacuccucccucugccccgucuccggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacuccggcgccgucgccguccucaaguacaacggcaucaucaccgacaccaucaaguccuggcgcaacaacaucaugcgcacccaggaguccgagugcgccugcgucaacggcuccugcuucaccaucaugaccgacggccccuccuccggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccuggaucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgagugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 117876 - RNA, 1350 nt, Artificial Sequence
  derived and/or modified sequence opt2 from neuraminidase__InfluenzaA__EPI594521
augaaccccaaccagaagaucaucaccaucggcuccaucugcgucggcaucggcaucgucucccucaugcuccagaucggcaacauggucuccaucugggucaaccacuccauccagaccgagaaccagugccaggccgaguccaucuccaacaccaaguuccucaccgagaaggccgucgcccccgucacccucaugggcaacuccucccucugccccaucuccggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcgcccucauguccugccccgucggcgaggcccccucccccuacaacucccgcuucgaguccgucgccugguccgccuccgccugccacgacggcaccggcuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagcucgagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagguccccuucaccaucgacaaguga

SEQ ID NO: 117877 - RNA, 1410 nt, Artificial Sequence
  derived and/or modified sequence opt2 from neuraminidase__InfluenzaA__EPI5787
augaaccccaaccagaagaucaucaccaucggcuccaucugcauggucgucggcaucaucucccucaugcuccagaucggcaacaucaucuccaucugggucucccacuccauccagaccggcaaccagcaccaggccgagcccugcaaccaguccaucaucaccuacgagaacaacaccugggucaaccagaccuacgucaacaucuccaacaccaacuuccucaccgagaaggccgucgccuccgucacccucgccggcaacuccucccucugccccaucuccggcugggccguccacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacgacgccgagcuccccuucaccaucgacaaguga

SEQ ID NO: 117878 - RNA, 1410 nt, Artificial Sequence; identical to SEQ ID NO: 117877
  derived and/or modified sequence opt2 from neuraminidase__InfluenzaA__EPI5787

SEQ ID NO: 117879 - RNA, 1350 nt, Artificial Sequence; identical to SEQ ID NO: 112577
  derived and/or modified sequence opt2 from neuraminidase__InfluenzaA__EPI267031

SEQ ID NO: 117880 - RNA, 1350 nt, Artificial Sequence; identical to SEQ ID NO: 114157
  derived and/or modified sequence opt2 from neuraminidase__InfluenzaA__EPI376539

SEQ ID NO: 117881 - RNA, 1350 nt, Artificial Sequence
  derived and/or modified sequence opt2 from neuraminidase__InfluenzaA__EPI124069
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117882 - RNA, 1350 nt, Artificial Sequence
  derived and/or modified sequence opt2 from neuraminidase__InfluenzaA__EPI342499
augaaccccaaccagaagaucaucaccaucggcuccaucugcauggucaucggcaucgucucccucaugcuccagaucggcaacaugaucuccaucuggaucucccacuccauccagaagggcaaccagcaccgcaccgaguccaucuccaacaccaacccccucaccgagaaggccgucgccuccgucacccucaccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugcccccucggcgaggcccccucccccuacaacucccgcuucgaguccgucgccugguccgccuccgccugccacgacggcaccggcuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaugcgcaagggcaaggucgucaaguccgucgagcucgacgcccccaacuaccacuacgaggagugcuccugcuaccccgacaccggcgagaucaccugcgucugccgcgacaacuggcacggcuccaaccgccccuggaucuccuucaaccagaaccucgaguaccagaucggcuacaucugcuccggcaucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117883 - RNA, 1350 nt, Artificial Sequence
  derived and/or modified sequence opt2 from neuraminidase__InfluenzaA__EPI103069
augaaccccaaccagaagaucaucaccaucggcuccaucugcauggucaucggcaucgucucccucaugcuccagaucggcaacaugaucuccaucugggucucccacuccauccagaccggcaaccagcgccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccaucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 117884 - RNA, 1350 nt, Artificial Sequence; identical to SEQ ID NO: 117860
  derived and/or modified sequence opt2 from neuraminidase__InfluenzaA__EPI227595

SEQ ID NO: 117885 - RNA, 1410 nt, Artificial Sequence
  derived and/or modified sequence opt2 from neuraminidase__InfluenzaA__EPI569385
augaaccccaaccagaagaucaucaccaucggcuccgucucccucaccaucgccaccgucugcuuccucaugcagaucgccauccucgccaccaccgucacccuccacuucaagcagaacgagugcuccaucccccccaacaaccaggucguccccugcgagcccaucaucaucgagaagaacaucaccgagaucgucuaccucaacaacaccaccaucgagaaggaggucugccccgagguccccgaguaccgcaacugguccaagccccagugccagaucaccggcuucgcccccuucuccaaggacaacuccauccgccucuccgccggcggcgacaucugggucacccgcgagcccuacgucuccugcucccccggcaagugcuaccaguucgcccucggccagggcaccacccucaacaacaagcacuccaacggcaccauccacgaccgcaucccccaccgcacccuccucauguccgagcucggcguccccuuccaccucggcaccaagcaggucugcaucgccugguccuccuccuccugccacgacggcaaggccuggcuccacgucugcgucaccggcgacgaccgcaacgccaccgccuccuucaucuacgacggcaugcucgccgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcgucugccgcgacaacuggaagggcuccaaccgccccgucaucgacaucaacauggccgacuacuccaucgacuccuccuacgucugcuccggccucgucggcgacaccccccgcaacgacgacuccuccuccuccuccaacugccgcgaccccaacaacgagcgcggcaaccccggcgucaagggcugggccuucgacaacggcaacgacgucuggaugggccgcaccaucuccgaggacucccgcuccggcuacgagaccuuccgcgucaccgacggcuggaccaccgccaacuccaagucccaggucaaccgccagaucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 117886 - RNA, 1380 nt, Artificial Sequence
  derived and/or modified sequence opt2 from neuraminidase__InfluenzaA__EPI736916
augaaccccaaccagaagaucaccugcaucuccgccaccggcgucacccucuccgucgucucccuccucaucggcaucgccaaccucggccucaacaucggccuccacuacaaggucuccgacuccaccaccaucuccauccccaacaugaacgagaccaaccccaccaccaccaacaucaccaacaucaucgucaacaagaacgaggagcgcaccuuccucaaccucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccgccacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggccggcaacauccuccgcacccaggaguccgagugcgucugccacaagggcaucugccccgucgucaugaccgacggccccgccaacaacaaggccgccaccaagaucaucuacuucaaggagggcaagguccagaagaucgaggagcuccagggcaacgcccagcacaucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggccccaccuccuaccagcucaucgucaacaaccagaacugguccggcuacuccggcgccuucaucgacuacugggccaacaaggagugcuucaaccccugcuucuacgucgagcucauccgcggccgccccaaggaguccgacguccucuggaccuccaacuccauggucgcccucugcggcucccgcgagcgccucggcuccugguccuggcacgacggcgccgagaucaucuacuucaaguga

SEQ ID NO: 117887 - RNA, 1380 nt, Artificial Sequence; identical to SEQ ID NO: 117506
  derived and/or modified sequence opt2 from neuraminidase__InfluenzaA__EPI593891

SEQ ID NO: 117888 - RNA, 1380 nt, Artificial Sequence
  derived and/or modified sequence opt2 from neuraminidase__InfluenzaA__EPI691380
augaaccccaaccagaagaucgucugcaucuccgucaccggcgucacccucuccgucgucucccuccucaucggcaucaccaaccucggccucaacaucggccuccacuacaaggucuccgacuccaccaccaucaacauccccaacaugaacgagaccaaccccaccaccaccaacaucaccaacaucaucaugaacaagaacgaggagcgcaccuuccucaagcucaccaagccccucugcgaggucaacuccuggcacauccucuccaaggacaacgccauccgcaucggcgaggacgcccacauccucgucacccgcgagcccuaccucuccugcgacccccagggcugccgcauguucgcccucucccagggcaccacccuccgcggccagcacgccaacggcaccauccacgaccgcucccccuuccgcgcccucaucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguaccgcggccgccccgucaccgagauccccuccugggccggcaacauccuccgcacccaggaguccgagugcgucugccacaagggcaucugccccgucgucaugaccgacggccccgccaacaacaaggccgccaccaagaucaucuacuucaaggagggcaagauccagaagaccgaggagcuccagggcaacgcccagcacaucgaggagugcuccugcuacggcgccgccggcaugaucaagugcgucugccgcgacaacuggaagggcgccaaccgccccaucaucaccaucgaccccgagaugaugacccacaccuccaaguaccucugcuccaagauccucaccgacaccucccgccccaacgaccccaccaacggcaacugcgacgcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaucgacauccaguccggccccaucuccuaccagcucgucgucaacaaccagaacugguccggcuacuccggcgccuucaucgacuacugggccaacaaggagugcuucaaccccugcuucuacgucgagcucauccgcggccgccccaaggaguccggcguccucuggaccuccaacuccauggucgcccucugcggcucccgcgagcgccucggcuccugguccuggcacgacggcgccgagaucaucuacuucaaguga

SEQ ID NO: 117889 - RNA, 1413 nt, Artificial Sequence
  derived and/or modified sequence opt2 from neuraminidase__InfluenzaA__EPI533584
augaaccccaaccagaagaucaccugcaucuccgccaccggcaugacccucuccgucgucuccaugcucaucggcaucgccaaccucggccucaacaucggccuccacuacaaggucuccgacuccaccaacaucaacauccccaacaugaacgagaccucccccaccaccaccaucaucaacaaccacccccagaacaacuucaccaacaucaccaacaucaucgucaccaagaacgaggagggccaccuccucaaccucaccaagccccucugcgaggucaacuccuggcacauccucuccaaggacaacgccauccgcaucggcgaggacgcccacaucaucgucacccgcgagcccuaccucuccugcgacccccagggcugccgcauguucgcccucucccagggcaccacccuccgcggcaagcacgccaacggcaccauccacgaccgcucccccuuccgcgcccucgucuccugggagaugggccaggcccccucccccuacaacacccgcgucgagugcaucggcugguccuccaccuccugccacgacggcaucucccgcauguccaucugcaucuccggccccaacaacaacgccuccgccgucgucugguacggcggccgccccgucaccgagauccccuccugggccggcaacauccuccgcacccaggaguccgagugcgucugccacggcggcaucugccccgucgucaugaccgacggccccgccaacaaccgcgccgagaccaagaucaucuacuucaaggagggcaagaucaagaagaucgaggagcucaagggcgacgcccagcacaucgaggagugcuccugcuacggcgccuccgagaugaucaagugcaucugccgcgacaacuggaagggcgccaaccgccccgucaucaccaucgaccccgagaugaugacccacaccuccaaguaccucugcuccaagauccucaccgacaccucccgccccaacgaccccaccaacggcaagugcgaggcccccaucaccggcggcucccccgaccccggcgucaagggcuucgccuuccucgacggcgagaacuccuggcucggccgcaccaucuccaaggacucccgcuccggcuacgagaugcucaagguccccaacgccgagaccgacacccaguccggcgccaucucccaccagaucaucgucaacaaccagaacugguccggcuacuccggcgccuucaucgacuacugggccaacaaggagugcuucaaccccugcuucuacgucgagcucauccgcggccgccccaaggaguccuccguccucuggaccuccaacuccaucgucgcccucugcggcuccaaggagcgccucggcuccugguccuggcacgacggcgccgagaucaucuacuucaaguga

SEQ ID NO: 117890 - RNA, 1380 nt, Artificial Sequence; identical to SEQ ID NO: 117510
  derived and/or modified sequence opt2 from neuraminidase__InfluenzaA__EPI641400

SEQ ID NO: 117891 - RNA, 1380 nt, Artificial Sequence; identical to SEQ ID NO: 117510
  derived and/or modified sequence opt2 from neuraminidase__InfluenzaA__EPI587620

SEQ ID NO: 117892 - RNA, 1410 nt, Artificial Sequence
  derived and/or modified sequence opt2 from neuraminidase__InfluenzaA__EPI569392
augaaccccaaccagaagaucgucaccaucggcucccucucccucggccucgucgucuucaacguccuccuccacgccgucuccaucauccucaccguccucgcccucggcaaguccgagaacaacggcaucugcaacggcaccgucguccgcgaguacaacgagaccguccgcaucgagaaggucacccagugguacaacaccuccgucgucgaguacgucccccacuggaacgagggcaccuacaucaacaacaccgagcccaucugcgacgucaagggcuucgcccccuucuccaaggacaacggcauccgcgucggcucccgcggccacaucuucgucauccgcgagcccuucgucuccugcucccccgucggcugccgcaccuucuuccucacccagggcucccuccucaacgacaagcacuccaacggcaccgucaaggaccgcucccccuuccgcacccucauguccgucgaggucggccagucccccaacgucuaccaggcccgcuucgaggccgucgccugguccgccaccgccugccacgacggcaagaaguggauggccaucggcgucaccggccccgacuccaaggccgucgccgucguccacuacggcggcguccccaccgacgucgucaacuccugggccggcgacauccuccgcacccaggaguccuccugcaccugcauccagggcaacugcuacugggucaugaccgacggccccgccaaccgccaggcccaguaccgcaucuacaaggccaaccagggcaagaucaucggccgcaaggacgucuccuucuccggcggccacaucgaggagugcuccugcuaccccaacgacggcaaggucgagugcgucugccgcgacaacuggaccggcaccaaccgccccguccucaucaucucccccgaccucuccuaccgcgucggcuaccucugcgccggccuccccuccgacaccccccgcggcgaggacacccaguucgucggcuccugcaccucccccaugggcaaccagggcuacggcgucaagggcuucggcuuccgccagggcaccgacgucugggucggccgcaccaucucccgcaccucccgcuccggcuucgagaucauccgcaucaagaacggcuggacccagaccuccaaggagcagauccgccgccaggucgucgucgacaacuccaacugguccggcuacuccggcuccuucacccuccccgucgagcucuccggccgcgagugccucguccccugcuucugggucgagaugauccgcggccgccccgaggagcgcaccaucuggaccuccuccuccuccaucgucaugugcggcgucgacuacgagaucgccgacugguccuggcacgacggcgccauccuccccuucgacaucgacaaguga

SEQ ID NO: 117893 - RNA, 1368 nt, Artificial Sequence
  derived and/or modified sequence opt2 from neuraminidase__InfluenzaA__EPI459857
augaaccccaaccagaagaucaucaccaucggcuccaucugcauggucaucggcaccgucucccucaucguccaggucggcaacaucauccucaucugggucaaccacuccauccagaccugcaucaccuacgagaacaacaccugggucaaccagaccuacgucuccaacaccaacuuccucaccggccaggccgucgccuccgucacccucgccggcaacuccucccucugccccaucuccggcugggccaucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccgucggcgaggcccccucccccuacaacucccgcuucgaguccgucgccugguccgccuccgccugccacgacggcaucaacuggcucaccaucggcaucuccggccccgacaacgaggccgucgccguccucaaguacaacggcgucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaucgagaagggcaaggucguccgcuccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaccggcuacaucugcuccggcgucuucggcgacuccccccgccccaacgacggcaccggcuccugcggccccgucuccuccaacggcgccuucggcgucaagggcuucuccuucaaguacggcaacggcgucuggaucggccgcaccaagaccaccaacucccgcuccggcuucgagaugaucugggaccccaacggcuggaccgagaccgacuccuccuucuccaugaagcaggacaucaucgccaucaccgacugguccggcuacuccggcuccuucguccagcaccccgagcucaccggccucaacugcaugcgccccugcuucugggucgagcucauccgcggccagccccgcgagaacaccaucuggaccuccggcuccuccaucuccuucugcggcgucaacuccgagaccgucggcugguccuggcccgacggcgccgagcuccccuucaccaucgacaaguga

SEQ ID NO: 117894 - RNA, 1416 nt, Artificial Sequence
  derived and/or modified sequence opt2 from neuraminidase__InfluenzaA__EPI242204
augaaccccaaccagaagcucuucgcccucuccggcgucgccaucgcccucuccguccucaaccuccucaucggcaucuccaacgucggccucaacgucucccuccaccucaagggcgagggcgucaagcaggagaacaaccucaccugcaccaccaucacccagaacaacaccaccgucgucgagaacaccuacgucaacaacaccaccaucaucaacaagggcaccaaccucaaggcccccaacuaccuccuccucaacaagucccucugcuccgucgagggcugggucgucaucgccaaggacaacgccauccgcuucggcgaguccgagcagaucaucgucacccgcgagcccuacgucuccugcgaccccuccggcugcaagauguacgcccuccaccagggcaccaccauccgcaacaagcacuccaacggcaccauccacgaccgcaccaccuuccgcggccucaucuccaccccccucggcaccccccccaccgucuccaacuccgacuucaucugcgucggcugguccuccaccuccugccacgacggcgucggccgcaugaccaucugcauccagggcaacaacgacaacgccaccgccaccgucuacuacaaccgccgccucaccaccaccaucaagaccugggccaagaacauccuccgcacccaggaguccgagugcgucugccacaacggcaccugcgccgucgucaugaccgacggccccgccuccucccaggccuacaccaagaucauguacuuccacaagggccucaucaucaaggaggagccccuccgcggcuccgcccgccacaucgaggagugcuccugcuacggccacgaccagaaggucuccugcgucugccgcgacaacuggcagggcgccaaccgccccaucaucgagaucgacauguccacccucgagcacaccucccgcuacgucugcaccggcguccucaccgacaccucccgccccggcgacaagcccaacggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccgagaccgaccccaacucccgcaucaucgagcgccaggagaucgucgacaacuccaacugguccggcuacuccggcuccuucaucgacuacugggacgaggccaacgagugcuacaaccccugcuucuacgucgagcucauccgcggccgccccgaggaggccaaguacgucugguggaccuccaacucccucaucgcccucugcggcucccccgucuccgucggcuccggcuccuuccccgacggcgcccagauccaguacuucuccuga

SEQ ID NO: 117895 - RNA, 1416 nt, Artificial Sequence
  derived and/or modified sequence opt2 from neuraminidase__InfluenzaA__EPI408029
augaaccccaaccagaagcucuucgcccucuccggcgucgccaucgcccucuccguccucaaccuccucaucggcaucuccaacgucggccucaacaugucccuccaccucaagggcgagggcgucaagcaggagaacaaccucaccugcaccaccaucacccagaacaacaccaccgucgucgagaacaccuacgucaacaacaccaccaucaucaacaagggcaccaaccucaaggcccccaacuaccuccuccucaacaagucccucugcuccgucgagggcugggucgucaucgccaaggacaacgccauccgcuucggcgaguccgagcagaucaucgucacccgcgagcccuacgucuccugcgaccccuccggcugcaagauguacgcccuccaccagggcaccaccauccgcaacaagcacuccaacggcaccauccacgaccgcaccaccuuccgcggccuccucuccaccccccucggcaccccccccaccgucuccaacuccgacuucaucugcgucggcugguccuccaccuccugccacgacggcgucggccgcaugaccaucugcauccagggcaacaacgacaacgccaccgccaccgucuacuacaaccgccgccucaccaccaccaucaagaccugggccaagaacauccuccgcacccaggaguccgagugcgucugccacaacggcaccugcgccgucgucaugaccgacggccccgccuccucccaggccuacaccaagaucauguacuuccacaagggccucaucaucaaggaggagccccuccgcggcuccgcccgccacaucgaggagugcuccugcuacggccacgaccagaaggucuccugcgucugccgcgacaacuggcagggcgccaaccgccccaucaucgagaucgacauguccacccucgagcacaccucccgcuacgucugcaccggcguccucaccgacaccucccgccccggcgacaagcccaacggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccgagaccgaccccaacucccgcaucaucgagcgccaggagaucgucgacaacuccaaccgcuccggcuacuccggcuccuucaucgacuacugggacgaggccaacgagugcuacaaccccugcuucuacgucgagcucauccgcggccgccccgaggaggccaaguacgucugguggaccuccaacucccucaucgcccucugcggcucccccgucuccgucggcuccggcuccuuccccgacggcgcccagauccaguacuucuccuga

SEQ ID NO: 117896 - RNA, 1398 nt, Artificial Sequence; identical to SEQ ID NO: 114966
  derived and/or modified sequence opt2 from neuraminidase__InfluenzaA__EPI439509

SEQ ID NO: 117897 - RNA, 1350 nt, Artificial Sequence; identical to SEQ ID NO: 117499
  derived and/or modified sequence opt2 from neuraminidase__InfluenzaA__EPI164223

SEQ ID NO: 117898 - RNA, 1398 nt, Artificial Sequence; identical to SEQ ID NO: 114966
  derived and/or modified sequence opt2 from neuraminidase__InfluenzaA__EPI486493

SEQ ID NO: 117899 - RNA, 1398 nt, Artificial Sequence
  derived and/or modified sequence opt2 from neuraminidase__InfluenzaA__EPI740737
augaaccccaaccagaagauccucugcaccuccgccaccgccaucaccaucuccgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagaucgaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccguccacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggccccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucguccagaucgaccccgucgccaugacccacaccucccaguacaucugcucccccguccucaccgacuccccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 117900 - RNA, 1398 nt, Artificial Sequence
  derived and/or modified sequence opt2 from neuraminidase__InfluenzaA__EPI730494
augaaccccaaccagaagauccucugcaccuccgccaccgccaucaccaucggcgccaucgccguccucaucggcaucgccaaccucggccucaacaucggccuccaccucaagcccggcugcaacugcucccacucccagcccgagaucaccaacaccucccagaccaucaucaacaacuacuacuccgagaccaacaucaccaacauccagauggaggagcgcaccuccaagaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcaucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 117901 - RNA, 1398 nt, Artificial Sequence
  derived and/or modified sequence opt2 from neuraminidase__InfluenzaA__EPI712925
augaaccccaaccagaagauccucugcaccuccgccaccgccaucaccaucggcgccaucgccguccucaucggcaucgccaaccucggccucaacaucggccuccaccucaagcccggcugcaacugcucccacucccagcccgagaccaccaacaccucccagaccaucaucaacaacuacuacaacgagaccaacaucaccaacauccagaucgaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccguccacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggccccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucguccagaucgaccccgucgccaugacccacaccucccaguacaucugcucccccguccucaccgacuccccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 117902 - RNA, 1398 nt, Artificial Sequence
  derived and/or modified sequence opt2 from neuraminidase__InfluenzaA__EPI448938
augaaccccaaccagaagauccucugcaccuccgccaccgccaucaucaucggcgccaucgccguccucaucggcauggccaaccucggccucaacaucggccuccaccucaagcccggcugcaacugcucccacucccagcccgagaccaccaacaccucccagaccaucaucaacaacuacuacaacgagaccaacaucaccaacauccagauggaggagcgcaccucccgcaacuucaacaaccucaccaagggccucugcaccaucaacuccuggcacaucuacggcaaggacaacgccguccgcaucggcgaguccuccgacguccucgucacccgcgagcccuacgucuccugcgaccccgacgagugccgcuucuacgcccucucccagggcaccaccauccgcggcaagcacuccaacggcaccauccacgaccgcucccaguaccgcgcccucaucuccuggccccucuccuccccccccaccgucuacaacucccgcgucgagugcaucggcugguccuccaccuccugccacgacggcaagucccgcauguccaucugcaucuccggccccaacaacaacgccuccgccgucgucugguacaaccgccgccccgucgccgagaucaacaccugggcccgcaacauccuccgcacccaggaguccgagugcgucugccacaacggcgucugccccgucgucuucaccgacggcuccgccaccggccccgccgacacccgcaucuacuacuucaaggagggcaagauccucaagugggagucccucaccggcaccgccaagcacaucgaggagugcuccugcuacggcgagcgcaccggcaucaccugcaccugccgcgacaacuggcagggcuccaaccgccccgucauccagaucgaccccgucgccaugacccacaccucccaguacaucugcucccccguccucaccgacaacccccgccccaacgaccccaacaucggcaagugcaacgaccccuaccccggcaacaacaacaacggcgucaagggcuucuccuaccucgacggcgccaacaccuggcucggccgcaccaucuccaccgccucccgcuccggcuacgagaugcucaagguccccaacgcccucaccgacgaccgcuccaagcccauccagggccagaccaucguccucaacgccgacugguccggcuacuccggcuccuucauggacuacugggccgagggcgacugcuaccgcgccugcuucuacgucgagcucauccgcggccgccccaaggaggacaaggucugguggaccuccaacuccaucgucuccaugugcuccuccaccgaguuccucggccaguggaacuggcccgacggcgccaagaucgaguacuuccucuga

SEQ ID NO: 117903 - RNA, 1410 nt, Artificial Sequence
  derived and/or modified sequence opt2 from neuraminidase__InfluenzaA__EPI445995
augaaccccaaccagaagaucaucgcccucggcuccgccucccucaccaucgccaucaucugccuccucauccagaucgccauccucgccaccaccaugacccuccacuucaugcagaacgagcacaccaacuccacccgcaacaaggucguccccugcgaguccaucaucaucgagcgcaacaucaccgagaucguccaccucaacggcaccaucaucgagaaggaguccugccccaaggccgucgaguacaagaacugguccaagccccagugccagaucaccggcuucgcccccuucuccaaggacaacuccauccgccucuccgccggcggcgacaucugggucacccgcgagcccuacgucuccugcucccucuccaagugcuaccaguucgcccucggccagggcaccacccucaacaaccgccacuccaacggcaccacccacgaccgcucccccuaccgcacccuccucauguccgagcucggcguccccuuccaccucggcaccaagcaggucugcaucgccugguccuccuccuccugccacgacggccgcgccuggcuccacgucugcgucaccggcgacgacaagaacgccaccgccuccgucaucuacggcggcaugcucaccgacuccaucggcuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuacaucaacgucgccgacuacuccaucgacuccuccuacgucugcuccggccucgucggcgacaccccccgcaacgaggacuccuccuccuccuccaacugccgcgaccccaacaacgagcgcggcggccccggcgucaagggcugggccuucgacaacggcgacgacgucuggaugggccgcaccaucaagaaggacucccgcgccggcuacgagaccuuccgcgucgucgacggcuggacccucgccaacuccaagucccagaccaaccgccaggucaucgucgacuccgacaacugguccggcuacuccggcauguucuccgucgagggcaagaccugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccgacaucaacuucauguccaucuga

SEQ ID NO: 117904 - RNA, 1410 nt, Artificial Sequence
  derived and/or modified sequence opt2 from neuraminidase__InfluenzaA__EPI470861
augaaccccaaccagaagaucaucgccaucggcuccgucucccucaccaucgccaccaucugccuccucaugcagaucgccauccucgccaccaccaugacccuccacuucaagcagaacgagugcaucaacuccuccaacaaccaggucguccccugcgagcccaucaucaucgagcgcaacaucaccgagaucguccaccucaacuccaccacccucgagaaggagaucugccccaaggucgccgacuaccgcaacugguccaagccccagugccagaucaccggcuucgcccccuucuccaaggacaacuccauccgccucuccgccggcggcgacaucugggucacccgcgagcccuacgucuccugcggccucggcaagugcuaccaguucgcccucggccagggcaccacccucgagaacaagcacuccaacggcaccgcccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgaccgcaacgccaccgccuccaucaucuacgacggcauccucgucgacuccaucggcuccugguccaagaacauccuccgcacccaggaguccgagugcgucugcaucaacggcaccugcgccgucgucaugaccgacggcuccgccuccggccgcgccgacacccgcauccucuucauccgcgagggcaagaucgcccacaucuccccccucuccggcuccgcccagcacgucgaggagugcuccugcuacccccgcuaccccgagguccgcugcgucugccgcgacaacuggaagggcuccaaccgccccguccucuacaucaacauggccaacuacuccaucgacuccuccuacgucugcuccggccucgucggcgacaccccccgcaacgacgaccgcuccuccuccuccaacugccgcgaccccaacaacgagcgcggcgcccccggcgucaagggcugggccuucgacaacggcaacgacaucuggaugggccgcaccaucaagaaggacucccgcuccggcuacgagaccuuccgcgucaucggcggcuggaccaccgccaacuccaagucccagaucaaccgccaggucaucgucgacuccgacaacuccuccggcuacuccggcaucuucuccgucgagggcaaguccugcaucaaccgcugcuucuacgucgagcucauccgcggccgccccaaggagacccgcgucugguggaccuccaacuccaucaucgucuucugcggcaccuccggcaccuacggcaccggcuccuggcccgacggcgccaacaucaacuucaugcccaucuga

SEQ ID NO: 117905 - RNA, 1401 nt, Artificial Sequence
  derived and/or modified sequence opt2 from neuraminidase__InfluenzaA__EPI498036
augaaccccaaccagaagaucaucgccaucggcuccgucucccucaucaucgccaucaucugccuccucaugcagaucgccauccucaccaccaccaugacccuccacuuccgccagaacgagugcuccaaccccuccaacaaccaggucaugcccugcgagcccaucauccucgagcgcaacaccguccaccucaacuccaccaucaucgagcgcgagaucugccccaaggucgccgacuacaagaacugguccaagccccagugccagaucaccggcuucgcccccuucuccaaggacaacuccauccgccucuccgccggcggcgacaucugggucacccgcgagcccuacgucuccugcucccucgacaagugcuaccaguucgcccucggccagggcaccacccucaagaacaagcacuccaacggcaccacccacgaccgcaccccccaccgcacccuccucaugaacgagcucggcguccccuuccaccucggcaccaagcaggucugcaucgccugguccuccuccuccugcuacgacggcaaggccuggcuccacaucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgacuccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccgucuga

SEQ ID NO: 117906 - RNA, 1410 nt, Artificial Sequence
  derived and/or modified sequence opt2 from neuraminidase__InfluenzaA__EPI470902
augaaccccaaccagaagaucgucgccaucggcuccgccucccucaccaucgccaccaugugccuccucaugcagaucgcccucuucgccaccaccaugacccuccacuucaagcagaccggcugcaccaacuccuccgacaaccaggccguccccugcggccccaucaucaucgagcgcaacaucaccgagaucguccaccucaacuccaccacccucgagaaggagaccugccccaaguccgccggcuaccgcaacugguccaagccccagugccagaucaccggcuucgcccccuucuccaaggacaacuccauccgccucgccgccgccggcgacaucugggucacccgcgagcccuacgucuccugcggccucggcaagugcuaccaguucgcccucggccagggcaccacccucgacaacaagcacuccaacggcaccacccacgaccgcaccccccaccgcacccuccucaugaacgagcucggcguccccuuccaccucgccaccaagcaggucugcaucgccugguccuccuccuccugccacgacggcaaggccuggcuccacgucugcgucaccggcgacgacaagaacgccaccgccuccaucaucuacgacggcauccucgucgacuccaucgccuccugguccaagaacauccuccgcacccaggaguccgagugcgucugcaucaacggcaccugcaccgucgucaugaccgacggcuccgccuccggccgcgccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuucaucaacauggccgacuacuccaucgacuccuccuacgucugcuccggccucgucggcgacaccccccgcaacgacgaccgcuccuccuccuccaacugccgcgaccccaacaacgagcgcggcgcccccggcgucaagggcugggccuucgacuccggcaacgacaucuggaugggccgcaccaucgagaaggacucccgcuccggcuacgagaccuuccgcgucaucggcggcugguccaccgccaacuccaagucccagaucaaccgccaggucaucgucgaccgcgacaacuccuccggcuacuccggcaucuucuccgucgagggcaaguccugcaucaaccgcugcuucuacgucgagcucauccgcggccgccccaaggagaaccgcgucugguggaccuccaacuccaucaucgucuucugcggcaccuccggcaccuacggcaccggcuccuggcccgacggcgccaacaucaaccucaugcccaucuga

SEQ ID NO: 117907 - RNA, 1401 nt, Artificial Sequence
  derived and/or modified sequence opt2 from neuraminidase__InfluenzaA__EPI838241
augaaccccaaccagaagaucaccgccaucggcuccgucucccucaucaucgccaucaucugccuccucaugcagaucgccauccucaccaccaccaugacccuccacuuccgccagaacgagugcuccaacuccuccaacaaccaggucaugcccugcgagcccaucaucaucgagcgcaacaccguccaccucaacuccaccaccaucgagcgcgagaucugccccaaggucgccgaguacaagaacugguccaagccccagugccagaucaccggcuucgcccccuucuccaaggacaacuccauccgccucuccgccuccggcgacaucugggucacccgcgagcccuacgucuccugcucccucgacaagugcuaccaguucgcccucggccagggcaccacccucaagaacaagcacuccaacggcaccgcccacgaccgcaccccccaccgcacccuccucaugaacgagcucggcguccccuuccaccucggcaccaagcaggucugcaucgccugguccuccuccuccugcuacgacggcaaggccuggcuccacgucugcgucaccggcgacgacaagaacgccaccgccuccaucaucuacgacggcaugcucgucgacuccaucggcuccugguccaagaacauccuccgcacccaggaguccgagugcgucugcaucaacggcaccugcgccgucgucaugaccgacggcuccgccuccggcaaggccgacacccgcguccucuucauccgcgagggcaagaucaucaacaucuccccccucuccggcuccgcccagcacgucgaggagugcuccugcuacccccgcuaccccgagguccgcugcgucugccgcgacaacuggaagggcuccaaccgccccauccucuacaucaacauggccgacuacuccaucgaguccuccuacgucugcuccggccucgucggcgacaccccccgcaacgacgacuccuccuccuccuccaacugccgcgaccccaacaacgagcgcggcgcccccggcgucaagggcugggccuucgacgacggcaacgacgucuggaugggccgcaccaucaagaacggcucccgcuccggcuacgagaccuuccgcgucgucaacggcuggaccauggccaacuccaagucccagaucaaccgccaggucaucgucgaguccgacgacugguccggcuacuccggcaucuucuccgucgagggcaagaagugcaucaaccgcugcuucuacgucgagcucauccgcggccgcccccaggagccccgcgucugguggaccuccaacuccaucaucgucuucugcggcaccuccggcaccuacggcaccggcuccuggcccgacggcgccaacaucaacuucaugcccaucuga

SEQ ID NO: 117908 - RNA, 1401 nt, Artificial Sequence; identical to SEQ ID NO: 117907
  derived and/or modified sequence opt2 from neuraminidase__InfluenzaA__EPI680525

SEQ ID NO: 117909 - RNA, 1401 nt, Artificial Sequence; identical to SEQ ID NO: 117515
  derived and/or modified sequence opt2 from neuraminidase__InfluenzaA__EPI690481

SEQ ID NO: 117910 - RNA, 1755 nt, Artificial Sequence
  derived and/or modified sequence opt2 from hemagglutinin__InfluenzaB__ABL76276
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117911 - RNA, 1755 nt, Artificial Sequence
  derived and/or modified sequence opt2 from hemagglutinin__InfluenzaB__ABL76287
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccaucgaggucccccacaucugcaccaaggaggaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117912 - RNA, 1755 nt, Artificial Sequence
  derived and/or modified sequence opt2 from hemagglutinin__InfluenzaB__ABL76298
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117913 - RNA, 1755 nt, Artificial Sequence
  derived and/or modified sequence opt2 from hemagglutinin__InfluenzaB__ABL76309
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagcgccccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccgaggaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117914 - RNA, 1755 nt, Artificial Sequence
  derived and/or modified sequence opt2 from hemagglutinin__InfluenzaB__ABL76331
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccaucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117915 - RNA, 1755 nt, Artificial Sequence
  derived and/or modified sequence opt2 from hemagglutinin__InfluenzaB__ABL76342
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucauccgcggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgacuucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117916 - RNA, 1755 nt, Artificial Sequence
  derived and/or modified sequence opt2 from hemagglutinin__InfluenzaB__ABL76353
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucauccgcggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgacuucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117917 - RNA, 1755 nt, Artificial Sequence
  derived and/or modified sequence opt2 from hemagglutinin__InfluenzaB__ABL76375
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117918 - RNA, 1755 nt, Artificial Sequence; identical to SEQ ID NO: 117917
  derived and/or modified sequence opt2 from hemagglutinin__InfluenzaB__ABL76386

SEQ ID NO: 117919 - RNA, 1755 nt, Artificial Sequence
  derived and/or modified sequence opt2 from hemagglutinin__InfluenzaB__ABL76408
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugcuucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcggcaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117920 - RNA, 1755 nt, Artificial Sequence
  derived and/or modified sequence opt2 from hemagglutinin__InfluenzaB__ABL76419
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugcuucaacugcaccgaccucgacgucgcccucggccgccccaugugcgucggcaucacccccuccgccaaggccuccauccuccacgagauccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcggcaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117921 - RNA, 1758 nt, Artificial Sequence
  derived and/or modified sequence opt2 from hemagglutinin__InfluenzaB__ABL76441
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagcccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacgagcucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117922 - RNA, 1758 nt, Artificial Sequence
  derived and/or modified sequence opt2 from hemagglutinin__InfluenzaB__ABL76463
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucaacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117923 - RNA, 1758 nt, Artificial Sequence
  derived and/or modified sequence opt2 from hemagglutinin__InfluenzaB__ABL76474
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacgagcucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117924 - RNA, 1758 nt, Artificial Sequence
  derived and/or modified sequence opt2 from hemagglutinin__InfluenzaB__ABL76485
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgucaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgagaacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117925 - RNA, 1758 nt, Artificial Sequence
  derived and/or modified sequence opt2 from hemagglutinin__InfluenzaB__ABL76507
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117926 - RNA, 1758 nt, Artificial Sequence
  derived and/or modified sequence opt2 from hemagglutinin__InfluenzaB__ABL76518
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagaaccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117927 - RNA, 1758 nt, Artificial Sequence
  derived and/or modified sequence opt2 from hemagglutinin__InfluenzaB__ABL76529
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgucaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117928 - RNA, 1758 nt, Artificial Sequence
  derived and/or modified sequence opt2 from hemagglutinin__InfluenzaB__ABL76540
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgaggucaagcccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117929 - RNA, 1758 nt, Artificial Sequence
  derived and/or modified sequence opt2 from hemagglutinin__InfluenzaB__ABL76551
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugauggccaucuucgucgucuacauggucucccgcgacaacgucuccugcuccaucugccucuga

SEQ ID NO: 117930 - RNA, 1758 nt, Artificial Sequence
  derived and/or modified sequence opt2 from hemagglutinin__InfluenzaB__ABL76562
augaaggccaucaucguccuccucauggucgucaccuccaacgccgaccgcaucugcacccgcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgucggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117931 - RNA, 1758 nt, Artificial Sequence
  derived and/or modified sequence opt2 from hemagglutinin__InfluenzaB__ABL76573
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117932 - RNA, 1758 nt, Artificial Sequence; identical to SEQ ID NO: 117931
  derived and/or modified sequence opt2 from hemagglutinin__InfluenzaB__ABL76584

SEQ ID NO: 117933 - RNA, 1758 nt, Artificial Sequence; identical to SEQ ID NO: 117931
  derived and/or modified sequence opt2 from hemagglutinin__InfluenzaB__ABL76595

SEQ ID NO: 117934 - RNA, 1758 nt, Artificial Sequence; identical to SEQ ID NO: 117931
  derived and/or modified sequence opt2 from hemagglutinin__InfluenzaB__ABL76606

SEQ ID NO: 117935 - RNA, 1758 nt, Artificial Sequence
  derived and/or modified sequence opt2 from hemagglutinin__InfluenzaB__ABL76617
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117936 - RNA, 1755 nt, Artificial Sequence
  derived and/or modified sequence opt2 from hemagglutinin__InfluenzaB__ABL76628
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgaggucccccacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117937 - RNA, 1755 nt, Artificial Sequence
  derived and/or modified sequence opt2 from hemagglutinin__InfluenzaB__ABL76639
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaaggccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117938 - RNA, 1755 nt, Artificial Sequence
  derived and/or modified sequence opt2 from hemagglutinin__InfluenzaB__ABL76683
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117939 - RNA, 1752 nt, Artificial Sequence
  derived and/or modified sequence opt2 from hemagglutinin__InfluenzaB__ABL76694
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagcgcgcccccggcggccccuaccgccucggcaccuccggcuccugccccaacgucaccucccgcgacggcuucuucgccaccauggccugggccgucccccgcgacaacaagaccgccaccaacccccucaccgucgagguccccuacaucugcaccaagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117940 - RNA, 1758 nt, Artificial Sequence
  derived and/or modified sequence opt2 from hemagglutinin__InfluenzaB__ABL76716
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgucaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117941 - RNA, 1755 nt, Artificial Sequence
  derived and/or modified sequence opt2 from hemagglutinin__InfluenzaB__ABL76760
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccaucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117942 - RNA, 1755 nt, Artificial Sequence
  derived and/or modified sequence opt2 from hemagglutinin__InfluenzaB__ABL76771
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccaucgaggucccccacaucugcaccaaggaggaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagauccucggccccuccgccgucgacaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117943 - RNA, 1755 nt, Artificial Sequence
  derived and/or modified sequence opt2 from hemagglutinin__InfluenzaB__ABL76782
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggcucccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacaucgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaaggcccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117944 - RNA, 1755 nt, Artificial Sequence; identical to SEQ ID NO: 117917
  derived and/or modified sequence opt2 from hemagglutinin__InfluenzaB__ABL76793

SEQ ID NO: 117945 - RNA, 1755 nt, Artificial Sequence; identical to SEQ ID NO: 117917
  derived and/or modified sequence opt2 from hemagglutinin__InfluenzaB__ABL76815

SEQ ID NO: 117946 - RNA, 1758 nt, Artificial Sequence
  derived and/or modified sequence opt2 from hemagglutinin__InfluenzaB__ABL76826
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccgagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117947 - RNA, 1758 nt, Artificial Sequence
  derived and/or modified sequence opt2 from hemagglutinin__InfluenzaB__ABL76837
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagguccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccgucgagguccccuacaucugcaccgagggcgaggaccagaucaccgucuggggcuuccacuccgacuccgagacccagauggccaagcucuacggcgacuccaagccccagaaguucaccuccuccuccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagcgcuacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117948 - RNA, 1755 nt, Artificial Sequence
  derived and/or modified sequence opt2 from hemagglutinin__InfluenzaB__ABL76848
augaaggccaucaucguccuccucauggucgucaccuccaacgccgaccgcaucugcaccggcaucaccuccuccaacuccucccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucaccccccccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117949 - RNA, 1755 nt, Artificial Sequence; identical to SEQ ID NO: 117917
  derived and/or modified sequence opt2 from hemagglutinin__InfluenzaB__ABL76859

SEQ ID NO: 117950 - RNA, 1755 nt, Artificial Sequence
  derived and/or modified sequence opt2 from hemagglutinin__InfluenzaB__ABL76881
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggccuccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacgagacccagaugaagaaccucuacggcgacuccaacccccagaaguucaccuccuccgccaacggcgucaccacccacuacgucucccagaucggcggcuuccccgaccagaaggaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117951 - RNA, 1755 nt, Artificial Sequence
  derived and/or modified sequence opt2 from hemagglutinin__InfluenzaB__ABL76892
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117952 - RNA, 1755 nt, Artificial Sequence
  derived and/or modified sequence opt2 from hemagglutinin__InfluenzaB__ABL76903
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccaguccgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccgcccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117953 - RNA, 1758 nt, Artificial Sequence
  derived and/or modified sequence opt2 from hemagglutinin__InfluenzaB__ABL76914
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccuccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagcgcuacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117954 - RNA, 1755 nt, Artificial Sequence
  derived and/or modified sequence opt2 from hemagglutinin__InfluenzaB__ABL76936
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117955 - RNA, 1755 nt, Artificial Sequence
  derived and/or modified sequence opt2 from hemagglutinin__InfluenzaB__ABL76947
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacgacaagacccagaugaagaaccucuacggcgacuccaacccccagaaguucaccuccuccaccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117956 - RNA, 1758 nt, Artificial Sequence
  derived and/or modified sequence opt2 from hemagglutinin__InfluenzaB__ABL76958
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacaucuccugcuccaucugccucuga

SEQ ID NO: 117957 - RNA, 1758 nt, Artificial Sequence
  derived and/or modified sequence opt2 from hemagglutinin__InfluenzaB__ABL76969
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccgcacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccauccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117958 - RNA, 1755 nt, Artificial Sequence
  derived and/or modified sequence opt2 from hemagglutinin__InfluenzaB__ABL76980
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccgacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117959 - RNA, 1752 nt, Artificial Sequence
  derived and/or modified sequence opt2 from hemagglutinin__InfluenzaB__ABL76991
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaucacccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaacaagauccagaugaagaaccucuacggcgacuccaacccccagaaguucaccuccuccgccaacggcaucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagaagggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117960 - RNA, 1755 nt, Artificial Sequence
  derived and/or modified sequence opt2 from hemagglutinin__InfluenzaB__ABL77002
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccaucgaggucccccacaucugcaccaaggaggaggaccagaucaccaucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117961 - RNA, 1755 nt, Artificial Sequence
  derived and/or modified sequence opt2 from hemagglutinin__InfluenzaB__ABL77013
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagaaccagaugaagaaccucuacggcgacuccgacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117962 - RNA, 1755 nt, Artificial Sequence
  derived and/or modified sequence opt2 from hemagglutinin__InfluenzaB__ABL77024
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacgacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117963 - RNA, 1755 nt, Artificial Sequence
  derived and/or modified sequence opt2 from hemagglutinin__InfluenzaB__ABL77035
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117964 - RNA, 1755 nt, Artificial Sequence
  derived and/or modified sequence opt2 from hemagglutinin__InfluenzaB__ABL77046
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacgacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117965 - RNA, 1755 nt, Artificial Sequence
  derived and/or modified sequence opt2 from hemagglutinin__InfluenzaB__ABL77057
augaaggccaucaucguccuccucauggucgucaccuccaaggccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgaggucaagcccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagccccagaugaagaaccucuacggcgacuccaacccccagaaguucaccuccuccgccaacggcaucaccacccacuacgucucccagaucggcggcuuccccgagcagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117966 - RNA, 1758 nt, Artificial Sequence
  derived and/or modified sequence opt2 from hemagglutinin__InfluenzaB__ABL77068
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgagaaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacaacgagaaccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117967 - RNA, 1758 nt, Artificial Sequence
  derived and/or modified sequence opt2 from hemagglutinin__InfluenzaB__ABL77090
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccucaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgagaaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacaacgagauccagauggucaagcucuacggcgacuccaagccccagaaguucaccuccuccgccaacggcgucaccacccacuacgucucccagaucggcggcuuccccaaccagaucgaggacggcggccucccccaguccggccgcaucgucgucgacuacaugguccagaaguccggcaagaccggcaccaucaccuaccagcgcggcauccuccucccccagaaggucuggugcgccuccggccgcuccaagaucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117968 - RNA, 1755 nt, Artificial Sequence
  derived and/or modified sequence opt2 from hemagglutinin__InfluenzaB__ABL77101
augaaggccaucaucguccuccucauggucgucaccuccaaggccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgaggucaagcccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacgacaagacccagaugaagaaccucuacggcgacuccaacccccagaaguucaccuccuccgccaacggcaucaccacccacuacgucucccagaucggcggcuuccccgagcagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117969 - RNA, 1758 nt, Artificial Sequence
  derived and/or modified sequence opt2 from hemagglutinin__InfluenzaB__ABL77134
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgagaaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacgccaccgccgccuccucccucgccgucacccucaugaucgccaucuucgucgucuacauggucucccgcgacaacgucuccugcuccaucugccucuga

SEQ ID NO: 117970 - RNA, 1758 nt, Artificial Sequence
  derived and/or modified sequence opt2 from hemagglutinin__InfluenzaB__ABL77145
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgaggaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117971 - RNA, 1755 nt, Artificial Sequence
  derived and/or modified sequence opt2 from hemagglutinin__InfluenzaB__ABL77156
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117972 - RNA, 1758 nt, Artificial Sequence
  derived and/or modified sequence opt2 from hemagglutinin__InfluenzaB__ABL77178
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgagaaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117973 - RNA, 1755 nt, Artificial Sequence
  derived and/or modified sequence opt2 from hemagglutinin__InfluenzaB__ABL77189
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggcauccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117974 - RNA, 1758 nt, Artificial Sequence
  derived and/or modified sequence opt2 from hemagglutinin__InfluenzaB__ABL77200
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaugggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaaggccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacggcaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117975 - RNA, 1755 nt, Artificial Sequence
  derived and/or modified sequence opt2 from hemagglutinin__InfluenzaB__ABL77222
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacuccaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117976 - RNA, 1758 nt, Artificial Sequence
  derived and/or modified sequence opt2 from hemagglutinin__InfluenzaB__ABL77233
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaagucccgcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117977 - RNA, 1758 nt, Artificial Sequence
  derived and/or modified sequence opt2 from hemagglutinin__InfluenzaB__ABL77244
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaccauccccuccgccaaggccuccauccuccacgaggucaagcccgucaccuccggcugcuuccccaucaugcacgaccgcaccaagauccgccagcuccccaaccuccuccgcggcuacgagcacauccgccucuccacccacaacgucaucaacgccgagaccgcccccggcggccccuacaaggucggcaccuccggcuccugccccaacgucaccaacggcaacggcuucuucgccaccauggccugggccguccccaagaacgacaacaacaagaccgccaccaacccccucaccgucgagguccccuacaucugcaccgagggcgaggaccagaucaccgucuggggcuuccacuccgacaacgaggcccagauggucaagcucuacggcgacuccaagccccagaaguucaccuccuccgccaacggcgucaccacccacuacgucucccagaucggcggcuuccccaaccaggccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagaagggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacaagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117978 - RNA, 1752 nt, Artificial Sequence
  derived and/or modified sequence opt2 from hemagglutinin__InfluenzaB__ABL77255
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaugggcaccauccccuccgccaaggccuccauccuccacgagguccgccccgucaccuccggcugcuuccccaucaugcacgaccgcaccaagauccgccagcuccccaaccuccuccgcggcuacgagaacauccgccucuccacccacaacgucaucaacgccgagcgcgcccccggcggccccuaccgccucggcaccuccggcuccugccccaacgucaccucccgcaacggcuucuucgccaccauggccugggccgucccccgcgacaacaagaccgccaccaacccccucaccgucgagguccccuacaucugcaccaagggcgaggaccagaucaccgucuggggcuuccacuccgacgacaagacccagaugaagaaccucuacggcgacuccaacccccagaaguucaccuccuccgccaacggcgucaccacccacuacgucucccagaucggcgacuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117979 - RNA, 1752 nt, Artificial Sequence
  derived and/or modified sequence opt2 from hemagglutinin__InfluenzaB__ABL77266
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagcgcgcccccggcggccccuaccgccucggcaccuccggcuccugccccaacgucaccucccgcgacggcuucuucgccaccauggccugggccgucccccgcgacaacaagaccgccaccaacccccucaccgucgagguccccuacaucugcaccaagggcgaggaccagaucaccgucuggggcuuccacuccgacuccaagacccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117980 - RNA, 1752 nt, Artificial Sequence
  derived and/or modified sequence opt2 from hemagglutinin__InfluenzaB__ABL77277
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaacacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagcgcgcccccggcggccccuaccgccucggcaccuccggcuccugccccaacgucaccaaccgcgacggcuucuucgccaccauggccugggccgucccccgcgacaacaagaccgccaccaacccccucaccgucgagguccccuacaucugcaccaagggcgaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117981 - RNA, 1752 nt, Artificial Sequence
  derived and/or modified sequence opt2 from hemagglutinin__InfluenzaB__ABL77288
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagcacauccgccucuccacccagaacgucaucaacgccgagaaggcccccggcggccccuacaagcucggcaccuccggcuccugccccaacgccaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaccaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117982 - RNA, 1752 nt, Artificial Sequence
  derived and/or modified sequence opt2 from hemagglutinin__InfluenzaB__ABL77299
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaacauccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaacgagacccagaugaagaaccucuacggcgacuccaacccccagaaguucaccuccuccgccaacggcaucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117983 - RNA, 1752 nt, Artificial Sequence
  derived and/or modified sequence opt2 from hemagglutinin__InfluenzaB__ABL77310
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaccauccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaacaagaaccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgucuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117984 - RNA, 1758 nt, Artificial Sequence
  derived and/or modified sequence opt2 from hemagglutinin__InfluenzaB__ABL77321
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaccauccccuccgccaaggucuccauccuccacgaggucaagcccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacaucaccaacggcaacggcuucuucgccaccauggccugggccguccccaagaacgacaacaacaagaccgccaccaacucccucaccgucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccaggccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaaccucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117985 - RNA, 1755 nt, Artificial Sequence
  derived and/or modified sequence opt2 from hemagglutinin__InfluenzaB__ABL77332
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuacaagcucggcaccuccggcuccugccccaacgccaccucccgcuccggcuucuucgccaccauggccugggccgucccccgcgacaacaacaagaccgccaccaacccccucaccgucgagguccccuacaucugcaccaagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacgccauccuccucuacuacuccaccgccgccuccucccucgccgucacccucaugaucgccaucuucaucgucuacauggucucccgcgacaacgucuccugcuccaucugccucuga

SEQ ID NO: 117986 - RNA, 1755 nt, Artificial Sequence
  derived and/or modified sequence opt2 from hemagglutinin__InfluenzaB__ABL77343
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaagggcgaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucgucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117987 - RNA, 1755 nt, Artificial Sequence
  derived and/or modified sequence opt2 from hemagglutinin__InfluenzaB__ABL77365
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccaggccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 117988 - RNA, 1755 nt, Artificial Sequence
  derived and/or modified sequence opt2 from hemagglutinin__InfluenzaB__ABL84340
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacaccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacggcgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117989 - RNA, 1755 nt, Artificial Sequence; identical to SEQ ID NO: 117910
  derived and/or modified sequence opt2 from hemagglutinin__InfluenzaB__ABN50382

SEQ ID NO: 117990 - RNA, 1755 nt, Artificial Sequence; identical to SEQ ID NO: 117910
  derived and/or modified sequence opt2 from hemagglutinin__InfluenzaB__ABN50393

SEQ ID NO: 117991 - RNA, 1755 nt, Artificial Sequence
  derived and/or modified sequence opt2 from hemagglutinin__InfluenzaB__ABN50404
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117992 - RNA, 1755 nt, Artificial Sequence; identical to SEQ ID NO: 117919
  derived and/or modified sequence opt2 from hemagglutinin__InfluenzaB__ABN50415

SEQ ID NO: 117993 - RNA, 1755 nt, Artificial Sequence; identical to SEQ ID NO: 117919
  derived and/or modified sequence opt2 from hemagglutinin__InfluenzaB__ABN50426

SEQ ID NO: 117994 - RNA, 1755 nt, Artificial Sequence
  derived and/or modified sequence opt2 from hemagglutinin__InfluenzaB__ABN50437
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgaccccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggcaaguccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 117995 - RNA, 1758 nt, Artificial Sequence
  derived and/or modified sequence opt2 from hemagglutinin__InfluenzaB__ABN50459
augaaggcccucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117996 - RNA, 1758 nt, Artificial Sequence
  derived and/or modified sequence opt2 from hemagglutinin__InfluenzaB__ABN50470
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgagaaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 117997 - RNA, 1755 nt, Artificial Sequence
  derived and/or modified sequence opt2 from hemagglutinin__InfluenzaB__ABN50481
augaaggccaucaucguccuccuccucgucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugcuucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117998 - RNA, 1755 nt, Artificial Sequence
  derived and/or modified sequence opt2 from hemagglutinin__InfluenzaB__ABN50503
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccguccccaaggacaacaacaagaccgccaccaacccccucaccgucgaggucccccacaucugcaccaaggaggaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 117999 - RNA, 1755 nt, Artificial Sequence
  derived and/or modified sequence opt2 from hemagglutinin__InfluenzaB__ABN50514
augaaggccaucaucguccuccucauggucgccaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagccccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacgacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118000 - RNA, 1755 nt, Artificial Sequence
  derived and/or modified sequence opt2 from hemagglutinin__InfluenzaB__ABN50525
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucuccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118001 - RNA, 1758 nt, Artificial Sequence
  derived and/or modified sequence opt2 from hemagglutinin__InfluenzaB__ABN50536
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgaggaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118002 - RNA, 1758 nt, Artificial Sequence
  derived and/or modified sequence opt2 from hemagglutinin__InfluenzaB__ABN50547
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagcucaccgucuggggcuuccacuccgacaacgagaaccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118003 - RNA, 1758 nt, Artificial Sequence
  derived and/or modified sequence opt2 from hemagglutinin__InfluenzaB__ABN50558
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaaggagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugaugcagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118004 - RNA, 1755 nt, Artificial Sequence; identical to SEQ ID NO: 117919
  derived and/or modified sequence opt2 from hemagglutinin__InfluenzaB__ABN50569

SEQ ID NO: 118005 - RNA, 1758 nt, Artificial Sequence; identical to SEQ ID NO: 117931
  derived and/or modified sequence opt2 from hemagglutinin__InfluenzaB__ABN50580

SEQ ID NO: 118006 - RNA, 1758 nt, Artificial Sequence
  derived and/or modified sequence opt2 from hemagglutinin__InfluenzaB__ABN50591
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgagaaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118007 - RNA, 1758 nt, Artificial Sequence
  derived and/or modified sequence opt2 from hemagglutinin__InfluenzaB__ABN50602
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaugggcaccauccccuccgccaaggccuccauccuccacgaggucaagcccgucaccuccggcugcuuccccaucaugcacgaccgcaccaagauccgccagcuccccaaccuccuccgcggcuacgagaacauccgccucuccacccacaacgucaucaacgccgagaccgcccccggcggccccuacaagaucggcaccuccggcuccugccccaacaucaccaacggcaacggcuucuucgccaccauggccugggccguccccaagaacgacaacaacaagaccgccaccaacccccucaccgucgagguccccuacaucugcaccgagggcgaggaccagaucaccgucuggggcuuccacuccgacaacgagacccagauggucaagcucuacggcgacuccaagccccagaaguucaccuccuccgccaacggcgucaccgcccacuacgucucccagaucggcggcuuccccaaccaggccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118008 - RNA, 1752 nt, Artificial Sequence
  derived and/or modified sequence opt2 from hemagglutinin__InfluenzaB__ABN50624
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaccauccccuccgccaaggccuccauccuccacgagguccgccccgucaccuccggcugcuuccccaucaugcacgaccgcaccaagauccgccagcuccccaaccuccuccgcggcuacgagaacauccgccucuccacccacaacgucaucaacgccgagcgcgcccccggcggccccuaccgccucggcaccuccggcuccugccccaacgucaccuccaaguccggcuucuucgccaccauggccugggccgucccccgcgacaacaagaccgccaccaacccccucaccgucgagguccccuacaucugcaccaagggcgaggaccagaucaccgucuggggcuuccacuccgacaacaagaaccagaugaagaaccucuacggcgacuccaacccccagaaguucaccuccuccgucaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118009 - RNA, 1752 nt, Artificial Sequence
  derived and/or modified sequence opt2 from hemagglutinin__InfluenzaB__ABN50635
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaccauccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacuccaagacccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118010 - RNA, 1752 nt, Artificial Sequence
  derived and/or modified sequence opt2 from hemagglutinin__InfluenzaB__ABN50646
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaccauccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaacaagaaccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118011 - RNA, 1752 nt, Artificial Sequence
  derived and/or modified sequence opt2 from hemagglutinin__InfluenzaB__ABN50657
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuaccgccucggcaccuccggcuccugccccaacgucaccucccgcaccggcuucuucgccaccauggccugggccgucccccgcgacaacaagaccgccaccaacccccucaccgucgagguccccuacaucugcaccaagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118012 - RNA, 1755 nt, Artificial Sequence
  derived and/or modified sequence opt2 from hemagglutinin__InfluenzaB__ABN50679
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118013 - RNA, 1755 nt, Artificial Sequence
  derived and/or modified sequence opt2 from hemagglutinin__InfluenzaB__ABN50690
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118014 - RNA, 1752 nt, Artificial Sequence
  derived and/or modified sequence opt2 from hemagglutinin__InfluenzaB__ABN50701
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuaccgccucggcaccuccggcuccugccccaacgucaccucccgcaccggcuucuucgccaccauggccugggccgucccccgcgacaacaagaccgccaccaacccccucaccgucgagguccccuacaucugcaccaagggcgaggaccagaucaccgucuggggcuuccacuccgacaacaaggcccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118015 - RNA, 1755 nt, Artificial Sequence; identical to SEQ ID NO: 118013
  derived and/or modified sequence opt2 from hemagglutinin__InfluenzaB__ABN50712

SEQ ID NO: 118016 - RNA, 1755 nt, Artificial Sequence
  derived and/or modified sequence opt2 from hemagglutinin__InfluenzaB__ABN50723
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccuccgcggcaccaagacccgcggcaagcucugccccaccugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118017 - RNA, 1755 nt, Artificial Sequence
  derived and/or modified sequence opt2 from hemagglutinin__InfluenzaB__ABN50734
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucaccaccauggccugggccgucccccgcgacaacaacaagaccgccaccaacccccucaccgucgaggucccccacaucugcaccaaggaggaggaccagaucaccgucuggggcuuccacuccgacgacaagacccagaugaagaaccucuacggcgacuccaacccccagaaguucaccuccuccaccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118018 - RNA, 1758 nt, Artificial Sequence
  derived and/or modified sequence opt2 from hemagglutinin__InfluenzaB__ABN50745
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacaucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118019 - RNA, 1752 nt, Artificial Sequence
  derived and/or modified sequence opt2 from hemagglutinin__InfluenzaB__ABN51184
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaccauccccuccgccaaggccuccauccuccacgagguccgccccgucaccuccggcugcuuccccaucaugcacgaccgcaccaagauccgccagcuccccaaccuccuccgcggcuacgagaacauccgccucuccacccacaacgucaucaacgccgagcgcgcccccggcggccccuaccgccucggcaccuccggcuccugccccaacgucaccuccaaguccggcuucuucgccaccauggccugggccgucccccgcgacaacaagaccgccaccaacccccucaccgucgagguccccuacaucugcaccaagggcgaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118020 - RNA, 1752 nt, Artificial Sequence
  derived and/or modified sequence opt2 from hemagglutinin__InfluenzaB__ABN51195
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaccauccccuccgccaaggccuccauccuccacgagguccgccccgucaccuccggcugcuuccccaucaugcacgaccgcaccaagauccgccagcuccccaaccuccuccgcggcuacgagaacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuucgacaacaagauccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118021 - RNA, 1758 nt, Artificial Sequence
  derived and/or modified sequence opt2 from hemagglutinin__InfluenzaB__ABN58661
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaccauccccuccgccaaggucuccauccuccacgaggucaagcccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccgucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccaggccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118022 - RNA, 1755 nt, Artificial Sequence; identical to SEQ ID NO: 117910
  derived and/or modified sequence opt2 from hemagglutinin__InfluenzaB__ABN59445

SEQ ID NO: 118023 - RNA, 1755 nt, Artificial Sequence
  derived and/or modified sequence opt2 from hemagglutinin__InfluenzaB__ABO72377
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugcuucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118024 - RNA, 1755 nt, Artificial Sequence; identical to SEQ ID NO: 117917
  derived and/or modified sequence opt2 from hemagglutinin__InfluenzaB__ABR15973

SEQ ID NO: 118025 - RNA, 1752 nt, Artificial Sequence
  derived and/or modified sequence opt2 from hemagglutinin__InfluenzaB__ABR15995
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaucacccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacuacaagacccagaugaagaaccucuacggcgacuccaacccccagaaguucaccuccuccgccaacggcaucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118026 - RNA, 1758 nt, Artificial Sequence
  derived and/or modified sequence opt2 from hemagglutinin__InfluenzaB__ABR16017
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118027 - RNA, 1758 nt, Artificial Sequence; identical to SEQ ID NO: 118026
  derived and/or modified sequence opt2 from hemagglutinin__InfluenzaB__ACA64899

SEQ ID NO: 118028 - RNA, 1758 nt, Artificial Sequence
  derived and/or modified sequence opt2 from hemagglutinin__InfluenzaB__ACA64932
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucuccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaucaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgacaagaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118029 - RNA, 1758 nt, Artificial Sequence; identical to SEQ ID NO: 118026
  derived and/or modified sequence opt2 from hemagglutinin__InfluenzaB__ACA64943

SEQ ID NO: 118030 - RNA, 1758 nt, Artificial Sequence
  derived and/or modified sequence opt2 from hemagglutinin__InfluenzaB__ACA64954
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccuccucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118031 - RNA, 1758 nt, Artificial Sequence; identical to SEQ ID NO: 118026
  derived and/or modified sequence opt2 from hemagglutinin__InfluenzaB__ACA64965

SEQ ID NO: 118032 - RNA, 1758 nt, Artificial Sequence
  derived and/or modified sequence opt2 from hemagglutinin__InfluenzaB__ACA64998
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugcuucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118033 - RNA, 1758 nt, Artificial Sequence
  derived and/or modified sequence opt2 from hemagglutinin__InfluenzaB__ACA65020
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucuccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgaggucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118034 - RNA, 1758 nt, Artificial Sequence; identical to SEQ ID NO: 118032
  derived and/or modified sequence opt2 from hemagglutinin__InfluenzaB__ACA65031

SEQ ID NO: 118035 - RNA, 1758 nt, Artificial Sequence
  derived and/or modified sequence opt2 from hemagglutinin__InfluenzaB__ACA65042
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucuccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucaucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118036 - RNA, 1758 nt, Artificial Sequence
  derived and/or modified sequence opt2 from hemagglutinin__InfluenzaB__ACA65053
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccgcaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118037 - RNA, 1758 nt, Artificial Sequence
  derived and/or modified sequence opt2 from hemagglutinin__InfluenzaB__ACA65075
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucacccucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118038 - RNA, 1758 nt, Artificial Sequence; identical to SEQ ID NO: 118026
  derived and/or modified sequence opt2 from hemagglutinin__InfluenzaB__ACA65086

SEQ ID NO: 118039 - RNA, 1758 nt, Artificial Sequence; identical to SEQ ID NO: 118026
  derived and/or modified sequence opt2 from hemagglutinin__InfluenzaB__ACA65097

SEQ ID NO: 118040 - RNA, 1758 nt, Artificial Sequence; identical to SEQ ID NO: 118026
  derived and/or modified sequence opt2 from hemagglutinin__InfluenzaB__ACA96552

SEQ ID NO: 118041 - RNA, 1758 nt, Artificial Sequence; identical to SEQ ID NO: 118026
  derived and/or modified sequence opt2 from hemagglutinin__InfluenzaB__ACA96563

SEQ ID NO: 118042 - RNA, 1758 nt, Artificial Sequence; identical to SEQ ID NO: 118026
  derived and/or modified sequence opt2 from hemagglutinin__InfluenzaB__ACA96574

SEQ ID NO: 118043 - RNA, 1758 nt, Artificial Sequence; identical to SEQ ID NO: 118026
  derived and/or modified sequence opt2 from hemagglutinin__InfluenzaB__ACA96585

SEQ ID NO: 118044 - RNA, 1758 nt, Artificial Sequence
  derived and/or modified sequence opt2 from hemagglutinin__InfluenzaB__ACA96596
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucgacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118045 - RNA, 1758 nt, Artificial Sequence; identical to SEQ ID NO: 118026
  derived and/or modified sequence opt2 from hemagglutinin__InfluenzaB__ACA96607

SEQ ID NO: 118046 - RNA, 1758 nt, Artificial Sequence
  derived and/or modified sequence opt2 from hemagglutinin__InfluenzaB__ACA96618
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucuuccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118047 - RNA, 1758 nt, Artificial Sequence; identical to SEQ ID NO: 118026
  derived and/or modified sequence opt2 from hemagglutinin__InfluenzaB__ACA96629

SEQ ID NO: 118048 - RNA, 1758 nt, Artificial Sequence; identical to SEQ ID NO: 118032
  derived and/or modified sequence opt2 from hemagglutinin__InfluenzaB__ACA96640
